US011136565B2

(12) United States Patent
Naji et al.

(10) Patent No.: US 11,136,565 B2
(45) Date of Patent: *Oct. 5, 2021

(54) MODIFIED ARCHAEAL FAMILY B POLYMERASES

(71) Applicant: Singular Genomics Systems, Inc., La Jolla, CA (US)

(72) Inventors: Souad Naji, La Jolla, CA (US); Carl W. Fuller, New Jersey, NJ (US); Eli Glezer, Del Mar, CA (US); Andrew Spaventa, San Diego, CA (US)

(73) Assignee: SINGULAR GENOMICS SYSTEMS, INC., La Jolla, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/568,089

(22) Filed: Sep. 11, 2019

(65) Prior Publication Data

US 2020/0080065 A1 Mar. 12, 2020

Related U.S. Application Data

(60) Provisional application No. 62/729,875, filed on Sep. 11, 2018.

(51) Int. Cl.
  *C12N 9/12* (2006.01)
  *C12P 19/34* (2006.01)

(52) U.S. Cl.
  CPC ............ *C12N 9/1252* (2013.01); *C12P 19/34* (2013.01); *C12Y 207/07007* (2013.01)

(58) Field of Classification Search
  CPC .................. C12N 9/1252; C12P 19/34; C12Y 207/07007
  See application file for complete search history.

(56) References Cited

U.S. PATENT DOCUMENTS

| | | |
|---|---|---|
| 5,034,506 A | 7/1991 | Summerton et al. |
| 5,235,033 A | 8/1993 | Summerton et al. |
| 5,756,334 A | 5/1998 | Perler et al. |
| 5,763,594 A | 6/1998 | Hiatt et al. |
| 5,808,045 A | 9/1998 | Hiatt et al. |
| 5,872,244 A | 2/1999 | Hiatt et al. |
| 6,232,465 B1 | 5/2001 | Hiatt et al. |
| 6,255,475 B1 | 7/2001 | Kwiatkowski |
| 6,664,079 B2 | 12/2003 | Ju et al. |
| 7,057,026 B2 | 6/2006 | Barnes et al. |
| 7,541,170 B2 | 6/2009 | Wang et al. |
| 7,541,444 B2 | 6/2009 | Milton et al. |
| 8,114,973 B2 | 2/2012 | Siddiqi et al. |
| 8,460,910 B2 | 6/2013 | Smith et al. |
| 8,852,910 B2 | 10/2014 | Smith et al. |
| 9,085,762 B2 | 7/2015 | Hogrefe et al. |
| 9,447,389 B2 | 9/2016 | Smith et al. |
| 9,765,309 B2 | 9/2017 | Chen et al. |
| 10,017,750 B2 | 7/2018 | Smith et al. |
| 10,041,115 B2 | 8/2018 | Stupi et al. |
| 10,421,996 B2 | 9/2019 | Bomati et al. |
| 11,034,942 B1 | 6/2021 | Naji et al. |
| 2004/0191825 A1 | 9/2004 | Wang et al. |
| 2006/0199214 A1 | 9/2006 | Jack et al. |
| 2006/0240439 A1 | 10/2006 | Smith et al. |
| 2011/0045489 A1 | 2/2011 | Gardner et al. |
| 2016/0090579 A1* | 3/2016 | Bomati ............... C12Q 1/6844 435/194 |
| 2017/0298327 A1 | 10/2017 | Bomati et al. |
| 2018/0274024 A1 | 9/2018 | Ju et al. |
| 2019/0077726 A1 | 3/2019 | Graham et al. |

FOREIGN PATENT DOCUMENTS

| | | |
|---|---|---|
| WO | WO-96/07669 A1 | 3/1996 |
| WO | WO-2004/018497 A2 | 3/2004 |
| WO | WO-2004/018497 A3 | 3/2004 |
| WO | WO-2005/024010 A1 | 3/2005 |
| WO | WO 2008/083393 A2 | 7/2008 |
| WO | WO 2008/083393 A3 | 7/2008 |
| WO | WO 2014/142921 A1 | 9/2014 |
| WO | WO-2015/200693 A1 | 12/2015 |
| WO | WO-2017/058953 A1 | 4/2017 |
| WO | WO-2017/205336 A1 | 11/2017 |
| WO | WO 2018/148723 A1 | 8/2018 |
| WO | WO-2020/056044 A1 | 3/2020 |

OTHER PUBLICATIONS

Whisstock et al. "Prediction of protein function from protein sequence and structure", Quaterly Reviews of Biophysics, 2003, 36(3):307-340.*
Witkowski et al. Conversion of a beta-ketoacyl synthase to a malonyl decarboxylase by replacement of the active-site cysteine with glutamine, Biochemistry. Sep. 7, 1999;38(36):11643-50.*
Truniger et al. Function of the C-terminus of φ29 DNA polymerase in DNA and terminal protein binding. Nucleic Acids Research, 2004, vol. 32, No. 1 361-370.*
Arezi, B. et al. (Sep. 27, 2002). "Efficient and high fidelity incorporation of dye-terminators by a novel archaeal DNA polymerase mutant," *J Mol Biol* 322(4):719-729.
Bentley, D.R. et al. (Nov. 6, 2008). "Accurate whole human genome sequencing using reversible terminator chemistry," *Nature* 456(7218):53-59, 55 pages of Supplementary material.
Bergen, K. et al. (Jun. 17, 2013, e-published Jun. 3, 2013). "Structures of KOD and 9° N DNA polymerases complexed with primer template duplex," *ChemBioChem* 14(9):1058-1062.
Canard, B. et al. (Oct. 11, 1994). "DNA polymerase fluorescent substrates with reversible 3'-tags," Gene 148(1):1-6.
Canard, B. et al. (Nov. 21, 1995). "Catalytic editing properties of DNA polymerases," *PNAS USA* 92(24):10859-10863.

(Continued)

*Primary Examiner* — Iqbal H Chowdhury
(74) *Attorney, Agent, or Firm* — Mintz, Levin, Cohn, Ferris, Glovsky and Popeo, P.C.

(57) ABSTRACT

Provided herein are modified Archaeal family B polymerases derived from the Archaeal microorganism *Pyrococcus abyssi* that exhibit improved incorporation of nucleotide analogues utilized in DNA sequencing.

28 Claims, 6 Drawing Sheets

Specification includes a Sequence Listing.

(56) References Cited

OTHER PUBLICATIONS

Chen, F. et al. (Feb. 2, 2010, e-published Jan. 11, 2010). "Reconstructed evolutionary adaptive paths give polymerases accepting reversible terminators for sequencing and SNP detection," *PNAS USA* 107(5):1948-1953.

Cohen, G.N. et al. (Mar. 2003). "An integrated analysis of the genome of the hyperthermophilic archaeon Pyrococcus abyssi," *Mol Microbiol* 47(6):1495-1512.

Dietrich, J. et al. (Nov. 19, 2002). "PCR performance of the highly thermostable proof-reading B-type DNA polymerase from Pyrococcus abyssi," *FEMS Nicrobiol Lett* 217(1):89-94.

Evans, S.J. et al. (Mar. 2000). "Improving dideoxynucleotide-triphosphate utilisation by the hyper-thermophilic DNA polymerase from the archaeon Pyrococcus furiosus," *Nucleic Acids Res* 28(5):1059-1066.

Filee, J. et al. (Jun. 2002). "Evolution of DNA polymerase families: evidences for multiple gene exchange between cellular and viral proteins," *J Mol Evol* 54(6):763-773.

Földesi, A. et al. (2007). "The fluoride cleavable 2-(cyanoethoxy)methyl (CEM) group as reversible 3'-O-terminator for DNA sequencing-by-synthesis—synthesis, incorporation, and cleavage," *Nucleosides, Nucleotides Nucleic Acids* 26(3):271-275.

Fuller, C.W. et al. (Nov. 2009, e-published Nov. 6, 2009). "The challenges of sequencing by synthesis," *Nat Biotechnol* 27(11):1013-1023.

Fuller, C.W. et al. (May 10, 2016, e-published Apr. 18, 2016). "Real-time single-molecule electronic DNA sequencing by synthesis using polymer-tagged nucleotides on a nanopore array," *PNAS USA* 113(19):5233-5238.

Gardner, A.F. et al. (Jun. 15, 1999). "Determinants of nucleotide sugar recognition in an archaeon DNA polymerase," *Nucleic Acids Res* 27(12):2545-2553.

Gardner, A.F. et al. (Jan. 15, 2002). "Acyclic and dideoxy terminator preferences denote divergent sugar recognition by archaeon and Taq DNA polymerases," *Nucleic Acids Res* 30(2):605-613.

Gueguen, Y. et al. (Nov. 2001). "Characterization of two DNA polymerases from the hyperthermophilic euryarchaeon Pyrococcus abyssi," *Eur J Biochem* 268(22):5961-5969.

Guo, J. et al. (Jul. 8, 2008, e-published Jun 30, 2008). "Four-color DNA sequencing with 3'O-modified nucleotide reversible terminators and chemically cleavable fluorescent dideoxynucleotides," *PNAS USA* 105(27):9145-9150, 13 pages of Supporting material.

Guo, J. et al. (Apr. 20, 2010). "An integrated system for DNA sequencing by synthesis using novel nucleotide analogues," *Acc Chem Res* 43(4):551-563.

Horhota, A. et al. (May 25, 2005). "Kinetic analysis of an efficient DNA-dependent TNA polymerase," *J Am Chem Soc* 127(20):7427-7434.

Hutter, D. et al. (Nov. 2010). "Labeled nucleoside triphosphates with reversibly terminating aminoalkoxyl groups," *Nucleosides Nucleotides Nucleic Acids* 29(11):879-895.

Ishino, S. et al. (Aug. 29, 2014,). "DNA polymerases as useful reagents for biotechnology—the history of developmental research in the field," *Front Microbiol* 5:465.

Ju, J. et al. (Dec. 26, 2006, e-published Dec. 14, 2006). "Four-color DNA sequencing by synthesis using cleavable fluorescent nucleotide reversible terminators," *PNAS USA* 103(52):19635-19640.

Kim, T.S. et al. (Jan. 4, 2010). "Novel 3'-O-fluorescently modified nucleotides for reversible termination of DNA synthesis," *ChemBioChem* 11(10):75-78.

Knapp, D.C. et al. (2011). "Fluoride-Cleavable, Fluorescently Labelled Reversible Terminators: Synthesis and Use in Primer Extension," *Chem Eur J* 17:2903-2915.

Kumar, S. et al. (2012, e-published Sep. 21, 2012). "PEG-labeled nucleotides and nanopore detection for single molecule DNA sequencing by synthesis," *Sci Rep* 2:684.

Metzker, M.L. et al. (Oct. 11, 1994). "Termination of DNA synthesis by novel 3'-modified-deoxyribonucleoside 5'-triphosphates," *Nucleic Acids Res* 22(20):4259-4267.

Needleman, S.B .et al. (Mar. 1970). "A general method applicable to the search for similarities in the amino acid sequence of two proteins," *J Mol Biol* 48(3):443-453.

Nikiforov, T.T. (May 15, 2011, e-published Feb. 26, 2011). "Fluorogenic polymerase, endonuclease, and ligase assays based on DNA substrates labeled with a single fluorophore," *Anal Biochem* 412(2):229-236.

Nikiforov, T.T. (Sep. 15, 2014, e-published Jun. 5, 2014). "Generic assay format for endo- and exonucleases based on fluorogenic substrates labeled with single fluorophores," *Anal Biochem* 461:67-73.

Pearson, W.R. et al. (Apr. 1988). "Improved tools for biological sequence comparison," *PNAS USA* 85(8):2444-2448.

Rosenblum, B.B. et al. (Nov. 1997). "New dye-labeled terminators for improved DNA sequencing patterns," *Nucleic Acids Res* 25(22):4500-4504.

Ruparel, H. et al. (Apr. 26, 2005). "Design and synthesis of a 3'-O-allyl photocleavable fluorescent nucleotide as a reversible terminator for DNA sequencing by synthesis," *PNAS USA* 102(17):5932-5937.

Smith T.F. et al. (Dec. 1981). "Comparison biosequences," *Adv Appl Math* 2(4):482-489.

Southworth, M.W. et al. (May 28, 1996). "Cloning of thermostable DNA polymerases from hyperthermophilic marine Archaea with emphasis on *Thermococcus* sp. 9 degrees N-7 and mutations affecting 3'-5' exonuclease activity," *PNAS USA* 93(11):5281-5285.

Tabor, S. et al. (Apr. 15, 1989). "Selective inactivation of the exonuclease activity of bacteriophage T7 DNA polymerase by in vitro mutagenesis," *J Biol Chem* 264(11):6447-6458.

Welch, M.B. et al. (1999). "Synthesis of Nucleosides Designed for Combinatorial DNA Sequencing," *Chem Eur J* 5(3):951-960.

Welch, M.B. et al. (Feb. 1999). "Synthesis of fluorescent, photolabile 3'-O-protected nucleoside triphosphates for the base addition sequencing scheme," *Nucleosides Nucleotides* 18(2):197-201.

Wu, J. et al. (Oct. 16, 2007, e-published Oct. 8, 2007). "3'-0-modified nucleotides as reversible terminators for pyrosequencing," *PNAS USA* 104(42):16462-16467.

Zhu, Z. et al. (Aug. 25, 1994). "Directly labeled Dna probes using fluorescent nucleotides with different length linkers," *Nucleic Acids Res* 22(16):3418-3422.

International Search Report dated Jan. 28, 2020 for PCT Application No. PCT/US2019/50678, filed Sep. 11, 2019.

Written Opinion dated Jan. 28, 2020 for PCT Application No. PCT/US2019/50678, filed Sep. 11, 2019.

Seo, T.S. et al. (Jan. 24, 2003). "Click chemistry to construct fluorescent oligonucleotides for DNA sequencing," *J Org Chem* 68(2):609-612.

\* cited by examiner

MODIFIED ARCHAEAL FAMILY B POLYMERASES

CROSS-REFERENCES TO RELATED APPLICATIONS

This application claims the benefit of U.S. Provisional Application No. 62/729,875, filed Sep. 11, 2018, which is incorporated herein by reference in its entirety and for all purposes.

SEQUENCE LISTING

The instant application contains a Sequence Listing which has been submitted electronically in ASCII format and is hereby incorporated by reference in its entirety. Said ASCII copy, created on Sep. 9, 2019, is named 051385-511001US SL.txt and is 1.35 Megabytes in size.

BACKGROUND

The present disclosure generally relates to modified polymerase enzymes that exhibit improved incorporation of nucleotide analogues utilized in DNA sequencing.

DNA-polymerases add nucleotide triphosphate (dNTP) residues to the 3'-end of the growing DNA chain, using a complementary DNA as template. Three motifs, A, B and C, are seen to be conserved across all DNA-polymerases. Initial experiments with native DNA polymerases revealed difficulties incorporating modified nucleotides. There are several examples in which DNA polymerases have been modified to increase the rates of incorporation of nucleotide analogues. For example, in order to increase the efficiency of incorporation of modified nucleotides, DNA polymerases have been engineered such that they lack 3'-5' exonuclease activity (designated exo-). The exo-variant of 9° N polymerase is described by Perler et al, 1998 U.S. Pat. No. 5,756,334 and by Southworth et al, 1996 Proc. Natl Acad. Sci USA 93:5281. As described in WO 2005/024010, modification to the motif A region of DNA polymerases effects on the ability of polymerases to incorporate nucleotide analogues having a substituent at the 3' position which is larger than a hydroxyl group (i.e., a reversible terminator). In the context of this application, the term "motif A region" specifically refers to the three amino acids functionally equivalent or homologous to amino acids 409, 410, and 411 in wild type *P. Abyssi*; these amino acids are functionally equivalent to 408, 409, 410 in 9° N polymerase.

Despite ongoing research, current modifications to the DNA polymerase still do not show sufficiently high incorporation rates of modified nucleotides. In nucleic acid sequencing applications, the modified nucleotide typically has a reversible terminator at the 3' position and a modified base (e.g., a base linked to a fluorophore via a cleavable linker). In case of cleavable linkers attached to the base, there is usually a residual spacer arm left after the cleavage. This residual modification may interfere with incorporation of subsequent nucleotides by polymerase. Therefore, it is highly desirable to have polymerases for carrying out sequencing by synthesis process (SBS) that are tolerable of these scars. In addition to rapid incorporation, the enzyme needs to be stable and have high incorporation fidelity. Discovering a polymerase that has suitable kinetics and low misincorporation error remains a challenge. Disclosed herein, inter alia, are solutions to these and other problems in the art.

BRIEF SUMMARY

Provided herein are modified Archaeal family B polymerases and methods of using the same.

Provided herein are modified Archaeal family B polymerases derived from the Archaeal microorganism *Pyrococcus abyssi*.

In an aspect, a modified *Pyrococcus abyssi* polymerase is provided. The polymerase includes an amino acid sequence that is at least 80% identical to a continuous 500 amino acid sequence within SEQ ID NO: 1. The polymerase has exonuclease activity that is reduced at least 80% relative to the exonuclease activity of a polymerase of SEQ ID NO: 1.

Provided herein are methods of using modified Archaeal family B polymerases for improved incorporation of modified nucleotides into a nucleic acid sequence.

In an aspect, a method of incorporating a modified nucleotide into a nucleic acid is provided. The method includes allowing the following components to interact: (i) a nucleic acid template, (ii) a nucleotide solution, and (iii) a polymerase. The polymerase used in the method includes an amino acid sequence that is at least 80% identical to a continuous 500 amino acid sequence within SEQ ID NO: 1. The polymerase used in the method has exonuclease activity that is reduced at least 80% relative to the exonuclease activity of a polymerase of SEQ ID NO: 1.

BRIEF DESCRIPTION OF THE DRAWINGS

FIG. 2A depicts the relative average halftime, Δt, for a series of mutants SG1441, SG1418, SG1424, SG1420, A65, SG1247, SG1262, SG1408, SG1415, SG1426, SG1461, SG1243, SG1463, SG1460, SG1429, SG1464, SG1419, SG1412, SG1462, SG1227, and A49 relative to the average half time of incorporation for SG1200 incorporating i-term reversible terminator probes. FIG. 2B depicts the relative average halftime, Δt, for a series of mutants A49, SG1251, SG1229, A101, SG1459, A61, SG1433, SG1458, SG1245, SG1266, SG1264, SG1217, SG1220, A59, SG1216, SG1210-T16, SG1257, A177, and SG1215, relative to the average half time of incorporation for SG1200 incorporating i-term reversible terminator probes. FIG. 2C depicts the relative average halftime, Δt, for a series of mutants SG1253, SG1457, SG1457, SG1250, SG1235, A60, SG1236, SG1214, A70, SG1237, SG1200, A69, SG1210, A56, A39, A62, A178, A46, and A179, relative to the average half time of incorporation for SG1200 incorporating i-term reversible terminator probes.

FIGS. 3A-3B show the measured absolute half time of incorporation of a modified nucleotide containing the reversible terminator moiety i-term1 for the variant enzymes listed in Table 5. FIGS. 3C-3D show the measured absolute half time of incorporation of a modified nucleotide containing the reversible terminator moiety i-term2 for the variant enzymes listed in Table 5.

DETAILED DESCRIPTION

Figure 1:
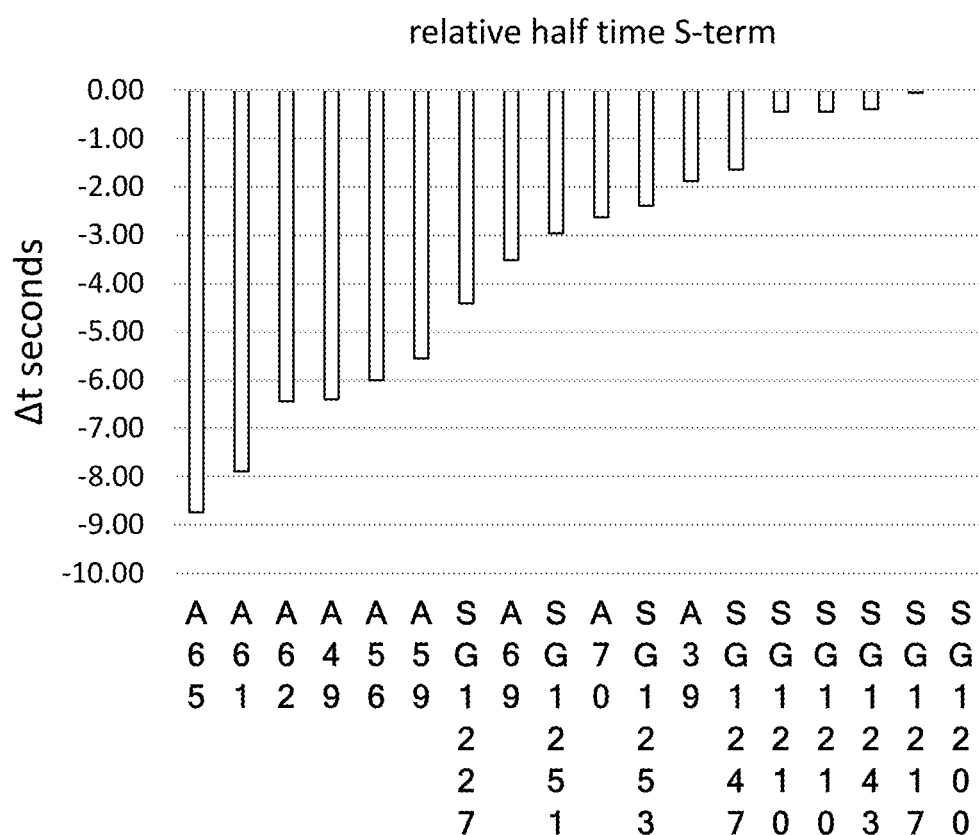
FIG. 1 is a chart showing the relative average halftime, Δt, for a series of mutants, A65, A61, A62, A49, A56, A59, SG1227, A69, SG1251, A70, SG1253, A39, SG1247, SG1210, SG1243, and SG1217 relative to the average half time of incorporation for SG1200 incorporating S-term reversible terminator probes.

Provided herein, are, for example, family B polymerases derived from Archaea modified for improved incorporation of modified nucleotides into a nucleic acid sequence and methods of use of the same.

I. Definitions

While various embodiments and aspects of the present invention are shown and described herein, it will be obvious to those skilled in the art that such embodiments and aspects are provided by way of example only. Numerous variations, changes, and substitutions will now occur to those skilled in the art without departing from the invention. It should be understood that various alternatives to the embodiments of the invention described herein might be employed in practicing the invention.

The section headings used herein are for organizational purposes only and are not to be construed as limiting the subject matter described. All documents, or portions of documents, cited in the application including, without limitation, patents, patent applications, articles, books, manuals, and treatises are hereby expressly incorporated by reference in their entirety for any purpose.

The abbreviations used herein have their conventional meaning within the chemical and biological arts. The chemical structures and formulae set forth herein are constructed according to the standard rules of chemical valency known in the chemical arts.

As used herein, the singular forms "a", "an", and "the" include plural references unless the context clearly dictates otherwise.

As used herein, the term "about" means a range of values including the specified value, which a person of ordinary skill in the art would consider reasonably similar to the specified value. In embodiments, the term "about" means within a standard deviation using measurements generally acceptable in the art. In embodiments, about means a range extending to +/−10% of the specified value. In embodiments, about means the specified value.

Unless defined otherwise, technical and scientific terms used herein have the same meaning as commonly understood by a person of ordinary skill in the art. See, e.g., Singleton et al., DICTIONARY OF MICROBIOLOGY AND MOLECULAR BIOLOGY 2nd ed., J. Wiley & Sons (New York, N.Y. 1994); Sambrook et al., MOLECULAR CLONING, A LABORATORY MANUAL, Cold Springs Harbor Press (Cold Springs Harbor, NY 1989). Any methods, devices and materials similar or equivalent to those described herein can be used in the practice of this invention. The following definitions are provided to facilitate understanding of certain terms used frequently herein and are not meant to limit the scope of the present disclosure.

"Nucleic acid" refers to nucleotides (e.g., deoxyribonucleotides or ribonucleotides) and polymers thereof in either single-, double- or multiple-stranded form, or complements thereof. The terms "polynucleotide," "oligonucleotide," "oligo" or the like refer, in the usual and customary sense, to a sequence of nucleotides. The term "nucleotide" refers, in the usual and customary sense, to a single unit of a polynucleotide, i.e., a monomer. Nucleotides can be ribonucleotides, deoxyribonucleotides, or modified versions thereof. Examples of polynucleotides contemplated herein include single and double stranded DNA, single and double stranded RNA, and hybrid molecules having mixtures of single and double stranded DNA and RNA with linear or circular framework. Non-limiting examples of polynucleotides include a gene, a gene fragment, an exon, an intron, intergenic DNA (including, without limitation, heterochromatic DNA), messenger RNA (mRNA), transfer RNA, ribosomal RNA, a ribozyme, cDNA, a recombinant polynucleotide, a branched polynucleotide, a plasmid, a vector, isolated DNA of a sequence, isolated RNA of a sequence, a nucleic acid probe, and a primer. Polynucleotides useful in the methods of the disclosure may comprise natural nucleic acid sequences and variants thereof, artificial nucleic acid sequences, or a combination of such sequences.

The term "duplex" in the context of polynucleotides refers, in the usual and customary sense, to double strandedness. Nucleic acids can be linear or branched. For example, nucleic acids can be a linear chain of nucleotides or the nucleic acids can be branched, e.g., such that the nucleic acids comprise one or more arms or branches of nucleotides. Optionally, the branched nucleic acids are repetitively branched to form higher ordered structures such as dendrimers and the like. Different polynucleotides may have different three-dimensional structures, and may perform various functions, known or unknown.

Nucleic acids, including e.g., nucleic acids with a phosphothioate backbone, can include one or more reactive moieties. As used herein, the term reactive moiety includes any group capable of reacting with another molecule, e.g., a nucleic acid or polypeptide through covalent, non-covalent or other interactions. By way of example, the nucleic acid can include an amino acid reactive moiety that reacts with an amino acid on a protein or polypeptide through a covalent, non-covalent or other interaction.

The terms "monophosphate" is used in accordance with its ordinary meaning in the arts and refers to a moiety having the formula:

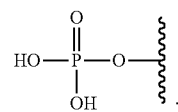 [SMILES: *OP(=O)(O)O]

The term "polyphosphate" refers to at least two phosphate groups, having the formula:

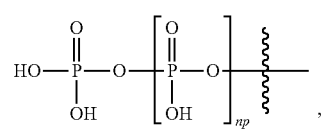

wherein np is an integer of 1 or greater and includes "diphosphate" and "triphosphate" with np=1 or 2 respectively. In embodiments, np is an integer from 0 to 5. In embodiments, np is an integer from 0 to 2. In embodiments, np is 2.

The term "base" as used herein refers to a purine or pyrimidine compound or a derivative thereof, that may be a constituent of nucleic acid (i.e. DNA or RNA, or a derivative thereof). In embodiments, the base is a derivative of a naturally occurring DNA or RNA base (e.g., a base analogue). In embodiments, the base is a base-pairing base. In embodiments, the base pairs to a complementary base. In embodiments, the base is capable of forming at least one hydrogen bond with a complementary base (e.g., adenine hydrogen bonds with thymine, adenine hydrogen bonds with uracil, guanine pairs with cytosine). Non-limiting examples of a base includes cytosine or a derivative thereof (e.g., cytosine analogue), guanine or a derivative thereof (e.g., guanine analogue), adenine or a derivative thereof (e.g., adenine analogue), thymine or a derivative thereof (e.g., thymine analogue), uracil or a derivative thereof (e.g., uracil analogue), hypoxanthine or a derivative thereof (e.g., hypoxanthine analogue), xanthine or a derivative thereof (e.g., xanthine analogue), guanosine or a derivative thereof (e.g., 7-methylguanosine analogue), deaza-adenine or a derivative thereof (e.g., deaza-adenine analogue), deaza-guanine or a derivative thereof (e.g., deaza-guanine), deaza-hypoxanthine or a derivative thereof, 5,6-dihydrouracil or a derivative thereof (e.g., 5,6-dihydrouracil analogue), 5-methylcytosine or a derivative thereof (e.g., 5-methylcytosine analogue), or 5-hydroxymethylcytosine or a derivative thereof (e.g., 5-hydroxymethylcytosine analogue) moieties. In embodiments, the base is thymine, cytosine, uracil, adenine, guanine, hypoxanthine, xanthine, theobromine, caffeine, uric acid, or isoguanine. In embodiments, the base is

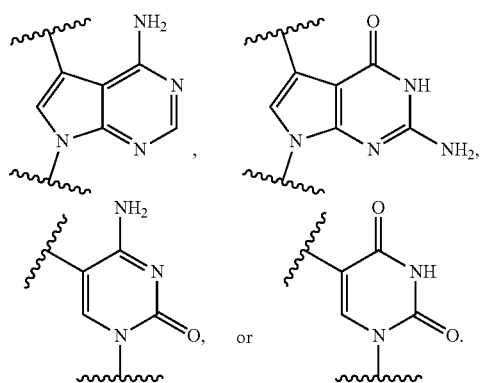

A polynucleotide is typically composed of a specific sequence of four nucleotide bases: adenine (A); cytosine (C); guanine (G); and thymine (T) (uracil (U) for thymine (T) when the polynucleotide is RNA). Thus, the term "polynucleotide sequence" is the alphabetical representation of a polynucleotide molecule; alternatively, the term may be applied to the polynucleotide molecule itself. This alphabetical representation can be input into databases in a computer having a central processing unit and used for bioinformatics applications such as functional genomics and homology searching. Polynucleotides may optionally include one or more non-standard nucleotide(s), nucleotide analog(s) and/or modified nucleotides.

The term "isolated", when applied to a nucleic acid or protein, denotes that the nucleic acid or protein is essentially free of other cellular components with which it is associated in the natural state. It can be, for example, in a homogeneous state and may be in either a dry or an aqueous solution. Purity and homogeneity are typically determined using analytical chemistry techniques such as polyacrylamide gel electrophoresis or high performance liquid chromatography. A protein that is the predominant species present in a preparation is substantially purified.

The term "analogue", in reference to a chemical compound, refers to compound having a structure similar to that of another one, but differing from it in respect of one or more different atoms, functional groups, or substructures that are replaced with one or more other atoms, functional groups, or substructures. In the context of a nucleotide useful in practicing the invention, a nucleotide analog refers to a compound that, like the nucleotide of which it is an analog, can be incorporated into a nucleic acid molecule (e.g., an extension product) by a suitable polymerase, for example, a DNA polymerase in the context of a dNTP analogue. The terms also encompass nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, include, without limitation, phosphodiester derivatives including, e.g., phosphoramidate, phosphorodiamidate, phosphorothioate (also known as phosphothioate having double bonded sulfur replacing oxygen in the phosphate), phosphorodithioate, phosphonocarboxylic acids, phosphonocarboxylates, phosphonoacetic acid, phosphonoformic acid, methyl phosphonate, boron phosphonate, or O-methylphosphoroamidite linkages (see Eckstein, OLIGONUCLEOTIDES AND ANALOGUES: A PRACTICAL APPROACH, Oxford University Press) as well as modifications to the nucleotide bases such as in 5-methyl cytidine or pseudouridine; and peptide nucleic acid backbones and linkages. Other analog nucleic acids include those with positive backbones; non-ionic backbones, modified sugars, and non-ribose backbones (e.g. phosphorodiamidate morpholino oligos or locked nucleic acids (LNA) as known in the art), including those described in U.S. Pat. Nos. 5,235,033 and 5,034,506, and Chapters 6 and 7, ASC Symposium Series 580, CARBOHYDRATE MODIFICATIONS IN ANTISENSE RESEARCH, Sanghui & Cook, eds. Nucleic acids containing one or more carbocyclic sugars are also included within one definition of nucleic acids. Modifications of the ribose-phosphate backbone may be done for a variety of reasons, e.g., to increase the stability and half-life of such molecules in physiological environments or as probes on a biochip. Mixtures of naturally occurring nucleic acids and analogs can be made; alternatively, mixtures of different nucleic acid analogs, and mixtures of naturally occurring nucleic acids and analogs may be made. In embodiments, the internucleotide linkages in DNA are phosphodiester, phosphodiester derivatives, or a combination of both.

The term "complement," as used herein, refers to a nucleotide (e.g., RNA or DNA) or a sequence of nucleotides capable of base pairing with a complementary nucleotide or sequence of nucleotides. As described herein and commonly known in the art the complementary (matching) nucleoside of adenosine is thymidine and the complementary (matching) nucleoside of guanosine is cytidine. Thus, a complement may include a sequence of nucleotides that base pair with corresponding complementary nucleotides of a second nucleic acid sequence. The nucleotides of a complement may match, partially or completely, the nucleotides of the second nucleic acid sequence. Where the nucleotides of the complement completely match each nucleotide of the second nucleic acid sequence, the complement forms base pairs with each nucleotide of the second nucleic acid sequence. Where the nucleotides of the complement partially match the nucleotides of the second nucleic acid sequence, only some of the nucleotides of the complement form base pairs with nucleotides of the second nucleic acid sequence.

Examples of complementary sequences include coding and non-coding sequences, wherein the non-coding sequence contains complementary nucleotides to the coding sequence and thus forms the complement of the coding sequence. A further example of complementary sequences are sense and antisense sequences, wherein the sense sequence contains complementary nucleotides to the antisense sequence and thus forms the complement of the antisense sequence.

As described herein the complementarity of sequences may be partial, in which only some of the nucleic acids match according to base pairing, or complete, where all the nucleic acids match according to base pairing. Thus, two sequences that are complementary to each other may have a specified percentage of nucleotides that are complementary (i.e., about 60% identity, preferably 65%, 70%, 75%, 80%, 85%, 90%, 91%, 92%, 93%, 94%, 95%, 96%, 97%, 98%, 99%, or higher complementarity over a specified region).

"DNA" refers to deoxyribonucleic acid, a polymer of deoxyribonucleotides (e.g., dATP, dCTP, dGTP, dTTP, dUTP, etc.) linked by phosphodiester bonds. DNA can be single-stranded (ssDNA) or double-stranded (dsDNA), and can include both single and double-stranded (or "duplex") regions. "RNA" refers to ribonucleic acid, a polymer of ribonucleotides linked by phosphodiester bonds. RNA can be single-stranded (ssRNA) or double-stranded (dsRNA), and can include both single and double-stranded (or "duplex") regions. Single-stranded DNA (or regions thereof) and ssRNA can, if sufficiently complementary, hybridize to form double-stranded DNA/RNA complexes (or regions).

The term "DNA primer" refers to any DNA molecule that may hybridize to a DNA template and be bound by a DNA polymerase and extended in a template-directed process for nucleic acid synthesis.

The term "DNA template" refers to any DNA molecule that may be bound by a DNA polymerase and utilized as a template for nucleic acid synthesis.

The term "dATP analogue" refers to an analogue of deoxyadenosine triphosphate (dATP) that is a substrate for a DNA polymerase.

The term "dCTP analogue" refers to an analogue of deoxycytidine triphosphate (dCTP) that is a substrate for a DNA polymerase.

The term "dGTP analogue" refers to an analogue of deoxyguanosine triphosphate (dGTP) that is a substrate for a DNA polymerase.

The term "dNTP analogue" refers to an analogue of deoxynucleoside triphosphate (dNTP) that is a substrate for a DNA polymerase The term "dTTP analogue" refers to an analogue of deoxythymidine triphosphate (dTTP) that is a substrate for a DNA polymerase.

The term "dUTP analogue" refers to an analogue of deoxyuridine triphosphate (dUTP) that is a substrate for a DNA polymerase.

The term "extendible" means, in the context of a nucleotide, primer, or extension product, that the 3'-OH group of the particular molecule is available and accessible to a DNA polymerase for extension or addition of nucleotides derived from dNTPs or dNTP analogues.

The term "modified nucleotide" refers to nucleotide modified in some manner. Typically, a nucleotide contains a single 5-carbon sugar moiety, a single nitrogenous base moiety and 1 to three phosphate moieties. In particular, embodiments, a nucleotide can include a blocking moiety or a label moiety. A blocking moiety on a nucleotide prevents formation of a covalent bond between the 3' hydroxyl moiety of the nucleotide and the 5' phosphate of another nucleotide. A blocking moiety on a nucleotide can be reversible, whereby the blocking moiety can be removed or modified to allow the 3' hydroxyl to form a covalent bond with the 5' phosphate of another nucleotide. A blocking moiety can be effectively irreversible under particular conditions used in a method set forth herein. A label moiety of a nucleotide can be any moiety that allows the nucleotide to be detected, for example, using a spectroscopic method. Exemplary label moieties are fluorescent labels, mass labels, chemiluminescent labels, electrochemical labels, detectable labels and the like. One or more of the above moieties can be absent from a nucleotide used in the methods and compositions set forth herein. For example, a nucleotide can lack a label moiety or a blocking moiety or both.

A "removable" group, e.g., a label or a blocking group or protecting group, refers to a chemical group that can be removed from a dNTP analogue such that a DNA polymerase can extend the nucleic acid (e.g., a primer or extension product) by the incorporation of at least one additional nucleotide. Removal may be by any suitable method, including enzymatic, chemical, or photolytic cleavage. Removal of a removable group, e.g., a blocking group, does not require that the entire removable group be removed, only that a sufficient portion of it be removed such that a DNA polymerase can extend a nucleic acid by incorporation of at least one additional nucleotide using a dNTP of dNTP analogue.

"Reversible blocking groups" or "reversible terminators" include a blocking moiety located, for example, at the 3' position of the nucleotide and may be a chemically cleavable moiety such as an allyl group, an azidomethyl group or a methoxymethyl group, or may be an enzymatically cleavable group such as a phosphate ester. Suitable nucleotide blocking moieties are described in applications WO 2004/018497, U.S. Pat. Nos. 7,057,026, 7,541,444, WO 96/07669, U.S. Pat. Nos. 5,763,594, 5,808,045, 5,872,244 and 6,232,465 the contents of which are incorporated herein by reference in their entirety. The nucleotides may be labelled or unlabelled. They may be modified with reversible terminators useful in methods provided herein and may be 3'-O-blocked reversible or 3'-unblocked reversible terminators. In nucleotides with 3'-O-blocked reversible terminators, the blocking group —OR [reversible terminating (capping) group] is linked to the oxygen atom of the 3'-OH of the pentose, while the label is linked to the base, which acts as a reporter and can be cleaved. The 3'-O-blocked reversible terminators are known in the art, and may be, for instance, a 3'-ONH$_2$ reversible terminator, a 3'-O-allyl reversible terminator, or a 3'-O-azidomethy reversible terminator.

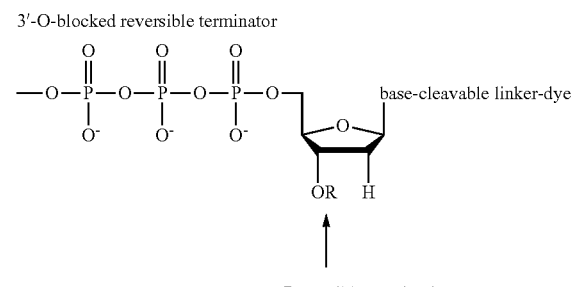

In embodiments, provided herein are polymerases capable of incorporating three differently sized reversible terminator probes linked to the 3' oxygen: an A-Term, S-Term, and i-term. A-Term refers to azide-containing terminators (Guo J, et al. PNAS 2008); for example having the formula:

S-Term refers to sulfide-containing terminators (WO 2017/058953); for example having the formula

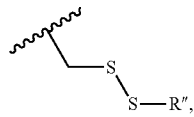

wherein R" is unsubstituted $C_1$-$C_4$ alkyl. The i-Term probe refers to an isomeric reversible terminator For example, an i-term probe has the formula:

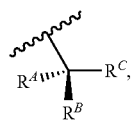

wherein $R^A$ and $R^B$ are hydrogen or alkyl, wherein at least one of $R^A$ or $R^B$ are hydrogen to yield a steroisomeric probe, and $R^C$ is the remainder of the reversible terminator.

In embodiments, the nucleotide is

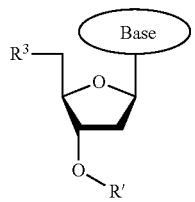

wherein Base is a Base as described herein, $R^3$ is —OH, monophosphate, or polyphosphate or a nucleic acid, and R' is a reversible terminator having the formula:

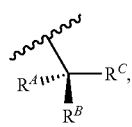

wherein $R^A$ and $R^B$ are hydrogen or alkyl and $R^C$ is the remainder of the reversible terminator. In embodiments, the reversible terminator is

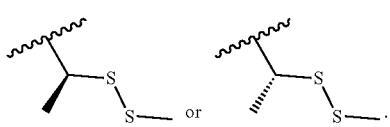

In embodiments, the reversible terminator is

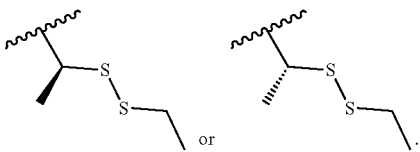

In embodiments, the reversible terminator is

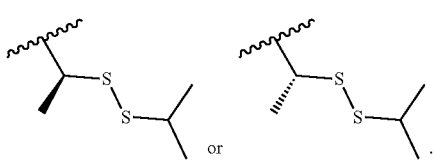

In embodiments, the reversible terminator is

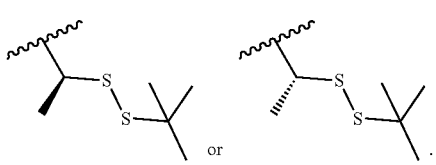

In embodiments, the reversible terminator is

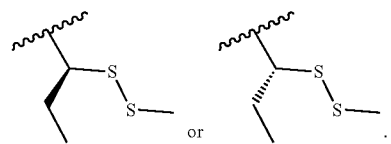

In embodiments, the reversible terminator is

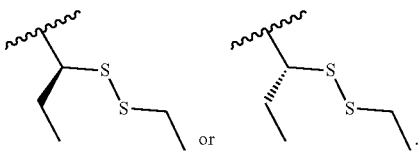

In embodiments, the reversible terminator is

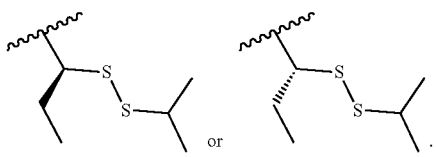

In embodiments, the reversible terminator is

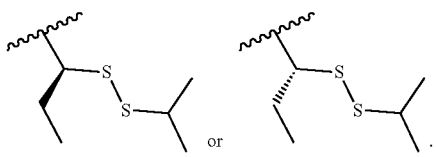

In embodiments, the reversible terminator is

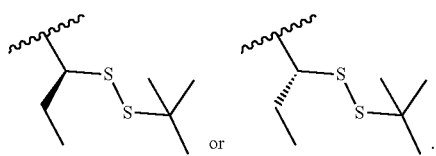

In embodiments, the reversible terminator is

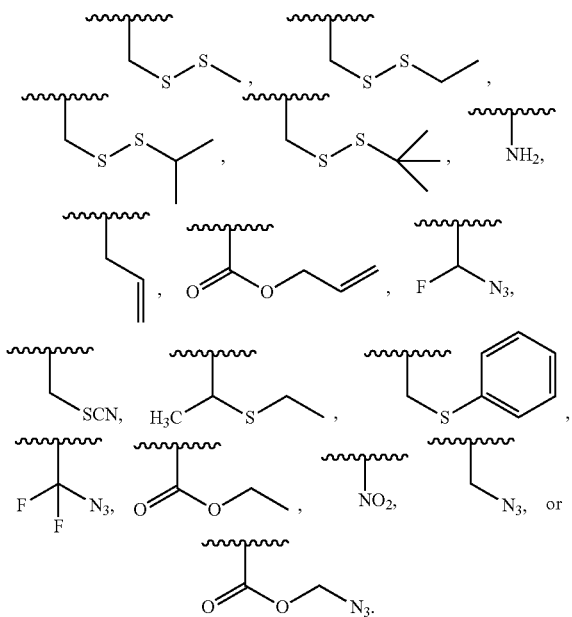

In nucleotides with 3'-unblocked reversible terminators, the termination group is linked to the base of the nucleotide as well as the label and functions not only as a reporter by as part of the reversible terminating group for termination of primer extension during sequencing. The 3'-unblocked reversible terminators are known in the art and include for example, the "virtual terminator" as described in U.S. Pat. No. 8,114,973 and the "Lightening terminator" as described in U.S. Pat. No. 10,041,115, the contents of which are incorporated herein by reference in their entirety.

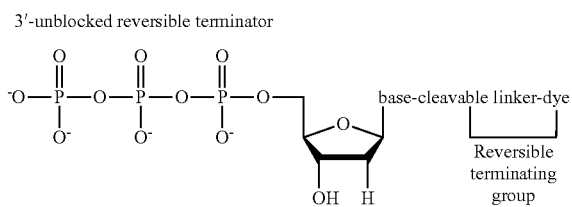

The term "alkyl," by itself or as part of another substituent, means, unless otherwise stated, a straight (i.e., unbranched) or branched carbon chain (or carbon), or combination thereof, which may be fully saturated, mono- or polyunsaturated and can include mono-, di- and multivalent radicals. The alkyl may include a designated number of carbons (e.g., $C_1$-$C_{10}$ means one to ten carbons). Alkyl is an uncyclized chain. Examples of saturated hydrocarbon radicals include, but are not limited to, groups such as methyl, ethyl, n-propyl, isopropyl, n-butyl, t-butyl, isobutyl, sec-butyl, homologs and isomers thereof, for example, n-pentyl, n-hexyl, n-heptyl, n-octyl, and the like. An unsaturated alkyl group is one having one or more double bonds or triple bonds. Examples of unsaturated alkyl groups include, but are not limited to, vinyl, 2-propenyl, crotyl, 2-isopentenyl, 2-(butadienyl), 2,4-pentadienyl, 3-(1,4-pentadienyl), ethynyl, 1- and 3-propynyl, 3-butynyl, and the higher homologs and isomers. An alkoxy is an alkyl attached to the remainder of the molecule via an oxygen linker (—O—). An alkyl moiety may be an alkenyl moiety. An alkyl moiety may be an alkynyl moiety. An alkyl moiety may be fully saturated. An alkenyl may include more than one double bond and/or one or more triple bonds in addition to the one or more double bonds. An alkynyl may include more than one triple bond and/or one or more double bonds in addition to the one or more triple bonds.

The term "alkylene," by itself or as part of another substituent, means, unless otherwise stated, a divalent radical derived from an alkyl, as exemplified, but not limited by, —CH$_2$CH$_2$CH$_2$CH$_2$—. Typically, an alkyl (or alkylene) group will have from 1 to 24 carbon atoms, with those groups having 10 or fewer carbon atoms being preferred herein. A "lower alkyl" or "lower alkylene" is a shorter chain alkyl or alkylene group, generally having eight or fewer carbon atoms. The term "alkenylene," by itself or as part of another substituent, means, unless otherwise stated, a divalent radical derived from an alkene.

The term "heteroalkyl," by itself or in combination with another term, means, unless otherwise stated, a stable straight or branched chain, or combinations thereof, including at least one carbon atom and at least one heteroatom (e.g., O, N, P, Si, and S), and wherein the nitrogen and sulfur atoms may optionally be oxidized, and the nitrogen heteroatom may optionally be quaternized. The heteroatom(s) (e.g., N, S, Si, or P) may be placed at any interior position of the heteroalkyl group or at the position at which the alkyl group is attached to the remainder of the molecule. Heteroalkyl is an uncyclized chain. Examples include, but are not limited to: —CH$_2$—CH$_2$—O—CH$_3$, —CH$_2$—CH$_2$—NH—CH$_3$, —CH$_2$—CH$_2$—N(CH$_3$)—CH$_3$, —CH$_2$—S—CH$_2$—CH$_3$, —CH$_2$—S—CH$_2$, —S(O)—CH$_3$, —CH$_2$—CH$_2$—S(O)$_2$—CH$_3$, —CH=CH—O—CH$_3$, —Si(CH$_3$)$_3$, —CH$_2$—CH=N—OCH$_3$, —CH=CH—N(CH$_3$)—CH$_3$, —O—CH$_3$, —O—CH$_2$—CH$_3$, and —CN. Two or three heteroatoms may be consecutive, such as, for example, —CH$_2$—NH—OCH$_3$ and —CH$_2$—O—Si(CH$_3$)$_3$. A heteroalkyl moiety may include one heteroatom (e.g., O, N, S, Si, or P). A heteroalkyl moiety may include two optionally different heteroatoms (e.g., O, N, S, Si, or P). A heteroalkyl moiety may include three optionally different heteroatoms (e.g., O, N, S, Si, or P). A heteroalkyl moiety may include four optionally different heteroatoms (e.g., O, N, S, Si, or P). A heteroalkyl moiety may include five optionally different heteroatoms (e.g., O, N, S, Si, or P). A heteroalkyl moiety may include up to 8 optionally different heteroatoms (e.g., O, N, S, Si, or P). The term "heteroalkenyl," by itself or in combination with another term, means, unless otherwise stated, a heteroalkyl including at least one double bond. A heteroalkenyl may optionally include more than one double bond and/or one or more triple bonds in additional to the one or more double bonds. The term "heteroalkynyl," by itself or in combination with another term, means, unless otherwise stated, a heteroalkyl including at least one triple bond. A heteroalkynyl may optionally include more than one triple bond and/or one or more double bonds in additional to the one or more triple bonds.

Similarly, the term "heteroalkylene," by itself or as part of another substituent, means, unless otherwise stated, a divalent radical derived from heteroalkyl, as exemplified, but not limited by, —CH$_2$—CH$_2$—S—CH$_2$—CH$_2$— and —CH$_2$—S—CH$_2$—CH$_2$—NH—CH$_2$—. For heteroalkylene groups, heteroatoms can also occupy either or both of the chain termini (e.g., alkyleneoxy, alkylenedioxy, alkyleneamino, alkylenediamino, and the like). Still further, for alkylene and heteroalkylene linking groups, no orientation of the linking group is implied by the direction in which the formula of the linking group is written. For example, the formula —C(O)$_2$R'— represents both —C(O)$_2$R'— and —R'C(O)$_2$—. As described above, heteroalkyl groups, as used herein, include those groups that are attached to the remainder of the molecule through a heteroatom, such as —C(O)R', —C(O)NR', —NR'R", —OR', —SR', and/or —SO$_2$R'. Where "heteroalkyl" is recited, followed by recitations of specific heteroalkyl groups, such as —NR'R" or the like, it will be understood that the terms heteroalkyl and —NR'R" are not redundant or mutually exclusive. Rather, the specific heteroalkyl groups are recited to add clarity. Thus, the term "heteroalkyl" should not be interpreted herein as excluding specific heteroalkyl groups, such as —NR'R" or the like.

The terms "cycloalkyl" and "heterocycloalkyl," by themselves or in combination with other terms, mean, unless otherwise stated, cyclic versions of "alkyl" and "heteroalkyl," respectively. Cycloalkyl and heterocycloalkyl are not aromatic. Additionally, for heterocycloalkyl, a heteroatom can occupy the position at which the heterocycle is attached to the remainder of the molecule. Examples of cycloalkyl include, but are not limited to, cyclopropyl, cyclobutyl, cyclopentyl, cyclohexyl, 1-cyclohexenyl, 3-cyclohexenyl, cycloheptyl, and the like. Examples of heterocycloalkyl include, but are not limited to, 1-(1,2,5,6-tetrahydropyridyl), 1-piperidinyl, 2-piperidinyl, 3-piperidinyl, 4-morpholinyl, 3-morpholinyl, tetrahydrofuran-2-yl, tetrahydrofuran-3-yl, tetrahydrothien-2-yl, tetrahydrothien-3-yl, 1-piperazinyl, 2-piperazinyl, and the like. A "cycloalkylene" and a "heterocycloalkylene," alone or as part of another substituent, means a divalent radical derived from a cycloalkyl and heterocycloalkyl, respectively.

In embodiments, the term "cycloalkyl" means a monocyclic, bicyclic, or a multicyclic cycloalkyl ring system. In embodiments, monocyclic ring systems are cyclic hydrocarbon groups containing from 3 to 8 carbon atoms, where such groups can be saturated or unsaturated, but not aromatic. In embodiments, cycloalkyl groups are fully saturated. Examples of monocyclic cycloalkyls include cyclopropyl, cyclobutyl, cyclopentyl, cyclopentenyl, cyclohexyl, cyclohexenyl, cycloheptyl, and cyclooctyl. Bicyclic cycloalkyl ring systems are bridged monocyclic rings or fused bicyclic rings. In embodiments, bridged monocyclic rings contain a monocyclic cycloalkyl ring where two non adjacent carbon atoms of the monocyclic ring are linked by an alkylene bridge of between one and three additional carbon atoms (i.e., a bridging group of the form (CH$_2$)$_w$, where w is 1, 2, or 3). Representative examples of bicyclic ring systems include, but are not limited to, bicyclo[3.1.1]heptane, bicyclo[2.2.1]heptane, bicyclo[2.2.2]octane, bicyclo[3.2.2]nonane, bicyclo[3.3.1]nonane, and bicyclo[4.2.1]nonane. In embodiments, fused bicyclic cycloalkyl ring systems contain a monocyclic cycloalkyl ring fused to either a phenyl, a monocyclic cycloalkyl, a monocyclic cycloalkenyl, a monocyclic heterocyclyl, or a monocyclic heteroaryl. In embodiments, the bridged or fused bicyclic cycloalkyl is attached to the parent molecular moiety through any carbon atom contained within the monocyclic cycloalkyl ring. In embodiments, cycloalkyl groups are optionally substituted with one or two groups which are independently oxo or thia. In embodiments, the fused bicyclic cycloalkyl is a 5 or 6 membered monocyclic cycloalkyl ring fused to either a phenyl ring, a 5 or 6 membered monocyclic cycloalkyl, a 5 or 6 membered monocyclic cycloalkenyl, a 5 or 6 membered monocyclic heterocyclyl, or a 5 or 6 membered monocyclic heteroaryl, wherein the fused bicyclic cycloalkyl is optionally substituted by one or two groups which are independently oxo or thia. In embodiments, multicyclic cycloalkyl ring systems are a monocyclic cycloalkyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two other ring systems independently selected from the group consisting of a phenyl, a bicyclic aryl, a monocyclic or bicyclic heteroaryl, a monocyclic or bicyclic cycloalkyl, a monocyclic or bicyclic cycloalkenyl, and a monocyclic or bicyclic heterocyclyl. In embodiments, the multicyclic cycloalkyl is attached to the parent molecular moiety through any carbon atom contained within the base ring. In embodiments, multicyclic cycloalkyl ring systems are a monocyclic cycloalkyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two other ring systems independently selected from the group consisting of a phenyl, a monocyclic heteroaryl, a monocyclic cycloalkyl, a monocyclic cycloalkenyl, and a monocyclic heterocyclyl. Examples of multicyclic cycloalkyl groups include, but are not limited to tetradecahydrophenanthrenyl, perhydrophenothiazin-1-yl, and perhydrophenoxazin-1-yl.

In embodiments, a cycloalkyl is a cycloalkenyl. The term "cycloalkenyl" is used in accordance with its plain ordinary meaning. In embodiments, a cycloalkenyl is a monocyclic, bicyclic, or a multicyclic cycloalkenyl ring system. In embodiments, monocyclic cycloalkenyl ring systems are cyclic hydrocarbon groups containing from 3 to 8 carbon atoms, where such groups are unsaturated (i.e., containing at least one annular carbon carbon double bond), but not aromatic. Examples of monocyclic cycloalkenyl ring systems include cyclopentenyl and cyclohexenyl. In embodiments, bicyclic cycloalkenyl rings are bridged monocyclic rings or a fused bicyclic rings. In embodiments, bridged monocyclic rings contain a monocyclic cycloalkenyl ring where two non adjacent carbon atoms of the monocyclic ring are linked by an alkylene bridge of between one and three additional carbon atoms (i.e., a bridging group of the form (CH$_2$)$_w$, where w is 1, 2, or 3). Representative examples of bicyclic cycloalkenyls include, but are not limited to, norbornenyl and bicyclo[2.2.2]oct 2 enyl. In embodiments, fused bicyclic cycloalkenyl ring systems contain a monocyclic cycloalkenyl ring fused to either a phenyl, a monocyclic cycloalkyl, a monocyclic cycloalkenyl, a monocyclic heterocyclyl, or a monocyclic heteroaryl. In embodiments, the bridged or fused bicyclic cycloalkenyl is attached to the parent molecular moiety through any carbon atom contained within the monocyclic cycloalkenyl ring. In embodiments, cycloalkenyl groups are optionally substituted with one or two groups which are independently oxo or thia. In embodiments, multicyclic cycloalkenyl rings contain a monocyclic cycloalkenyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two ring systems independently selected from the group consisting of a phenyl, a bicyclic aryl, a monocyclic or bicyclic heteroaryl, a monocyclic or bicyclic cycloalkyl, a monocyclic or bicyclic cycloalkenyl, and a monocyclic or bicyclic heterocyclyl. In embodiments, the multicyclic cycloalkenyl is attached to the parent molecular moiety through any carbon atom contained within the base ring. In embodiments, multicyclic cycloalkenyl rings contain a monocyclic cycloalkenyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two ring systems independently selected from the group consisting of a phenyl, a monocyclic heteroaryl, a monocyclic cycloalkyl, a monocyclic cycloalkenyl, and a monocyclic heterocyclyl.

In embodiments, a heterocycloalkyl is a heterocyclyl. The term "heterocyclyl" as used herein, means a monocyclic, bicyclic, or multicyclic heterocycle. The heterocyclyl monocyclic heterocycle is a 3, 4, 5, 6 or 7 membered ring containing at least one heteroatom independently selected from the group consisting of O, N, and S where the ring is saturated or unsaturated, but not aromatic. The 3 or 4 membered ring contains 1 heteroatom selected from the group consisting of O, N and S. The 5 membered ring can contain zero or one double bond and one, two or three heteroatoms selected from the group consisting of O, N and S. The 6 or 7 membered ring contains zero, one or two double bonds and one, two or three heteroatoms selected from the group consisting of O, N and S. The heterocyclyl monocyclic heterocycle is connected to the parent molecular moiety through any carbon atom or any nitrogen atom contained within the heterocyclyl monocyclic heterocycle. Representative examples of heterocyclyl monocyclic heterocycles include, but are not limited to, azetidinyl, azepanyl, aziridinyl, diazepanyl, 1,3-dioxanyl, 1,3-dioxolanyl, 1,3-dithiolanyl, 1,3-dithianyl, imidazolinyl, imidazolidinyl, isothiazolinyl, isothiazolidinyl, isoxazolinyl, isoxazolidinyl, morpholinyl, oxadiazolinyl, oxadiazolidinyl, oxazolinyl, oxazolidinyl, piperazinyl, piperidinyl, pyranyl, pyrazolinyl, pyrazolidinyl, pyrrolinyl, pyrrolidinyl, tetrahydrofuranyl, tetrahydrothienyl, thiadiazolinyl, thiadiazolidinyl, thiazolinyl, thiazolidinyl, thiomorpholinyl, 1,1-dioxidothiomorpholinyl (thiomorpholine sulfone), thiopyranyl, and trithianyl. The heterocyclyl bicyclic heterocycle is a monocyclic heterocycle fused to either a phenyl, a monocyclic cycloalkyl, a monocyclic cycloalkenyl, a monocyclic heterocycle, or a monocyclic heteroaryl. The heterocyclyl bicyclic heterocycle is connected to the parent molecular moiety through any carbon atom or any nitrogen atom contained within the monocyclic heterocycle portion of the bicyclic ring system. Representative examples of bicyclic heterocyclyls include, but are not limited to, 2,3-dihydrobenzofuran-2-yl, 2,3-dihydrobenzofuran-3-yl, indolin-1-yl, indolin-2-yl, indolin-3-yl, 2,3-dihydrobenzothien-2-yl, decahydroquinolinyl, decahydroisoquinolinyl, octahydro-1H-indolyl, and octahydrobenzofuranyl. In embodiments, heterocyclyl groups are optionally substituted with one or two groups which are independently oxo or thia. In certain embodiments, the bicyclic heterocyclyl is a 5 or 6 membered monocyclic heterocyclyl ring fused to a phenyl ring, a 5 or 6 membered monocyclic cycloalkyl, a 5 or 6 membered monocyclic cycloalkenyl, a 5 or 6 membered monocyclic heterocyclyl, or a 5 or 6 membered monocyclic heteroaryl, wherein the bicyclic heterocyclyl is optionally substituted by one or two groups which are independently oxo or thia. Multicyclic heterocyclyl ring systems are a monocyclic heterocyclyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two other ring systems independently selected from the group consisting of a phenyl, a bicyclic aryl, a monocyclic or bicyclic heteroaryl, a monocyclic or bicyclic cycloalkyl, a monocyclic or bicyclic cycloalkenyl, and a monocyclic or bicyclic heterocyclyl. The multicyclic heterocyclyl is attached to the parent molecular moiety through any carbon atom or nitrogen atom contained within the base ring. In embodiments, multicyclic heterocyclyl ring systems are a monocyclic heterocyclyl ring (base ring) fused to either (i) one ring system selected from the group consisting of a bicyclic aryl, a bicyclic heteroaryl, a bicyclic cycloalkyl, a bicyclic cycloalkenyl, and a bicyclic heterocyclyl; or (ii) two other ring systems independently selected from the group consisting of a phenyl, a monocyclic heteroaryl, a monocyclic cycloalkyl, a monocyclic cycloalkenyl, and a monocyclic heterocyclyl. Examples of multicyclic heterocyclyl groups include, but are not limited to 10H-phenothiazin-10-yl, 9,10-dihydroacridin-9-yl, 9,10-dihydroacridin-10-yl, 10H-phenoxazin-10-yl, 10,11-dihydro-5H-dibenzo[b,f]azepin-5-yl, 1,2,3,4-tetrahydropyrido[4,3-g]isoquinolin-2-yl, 12H-benzo[b]phenoxazin-12-yl, and dodecahydro-1H-carbazol-9-yl.

The terms "halo" or "halogen," by themselves or as part of another substituent, mean, unless otherwise stated, a fluorine, chlorine, bromine, or iodine atom. Additionally, terms such as "haloalkyl" are meant to include monohaloalkyl and polyhaloalkyl. For example, the term "halo($C_1$-$C_4$) alkyl" includes, but is not limited to, fluoromethyl, difluoromethyl, trifluoromethyl, 2,2,2-trifluoroethyl, 4-chlorobutyl, 3-bromopropyl, and the like.

The term "acyl" means, unless otherwise stated, —C(O)R where R is a substituted or unsubstituted alkyl, substituted or unsubstituted cycloalkyl, substituted or unsubstituted heteroalkyl, substituted or unsubstituted heterocycloalkyl, substituted or unsubstituted aryl, or substituted or unsubstituted heteroaryl.

The term "aryl" means, unless otherwise stated, a polyunsaturated, aromatic, hydrocarbon substituent, which can be a single ring or multiple rings (preferably from 1 to 3 rings) that are fused together (i.e., a fused ring aryl) or linked covalently. A fused ring aryl refers to multiple rings fused together wherein at least one of the fused rings is an aryl ring. The term "heteroaryl" refers to aryl groups (or rings) that contain at least one heteroatom such as N, O, or S, wherein the nitrogen and sulfur atoms are optionally oxidized, and the nitrogen atom(s) are optionally quaternized. Thus, the term "heteroaryl" includes fused ring heteroaryl groups (i.e., multiple rings fused together wherein at least one of the fused rings is a heteroaromatic ring). A 5,6-fused ring heteroarylene refers to two rings fused together, wherein one ring has 5 members and the other ring has 6 members, and wherein at least one ring is a heteroaryl ring. Likewise, a 6,6-fused ring heteroarylene refers to two rings fused together, wherein one ring has 6 members and the other ring has 6 members, and wherein at least one ring is a heteroaryl ring. And a 6,5-fused ring heteroarylene refers to two rings fused together, wherein one ring has 6 members and the other ring has 5 members, and wherein at least one ring is a heteroaryl ring. A heteroaryl group can be attached to the remainder of the molecule through a carbon or heteroatom. Non-limiting examples of aryl and heteroaryl groups include phenyl, naphthyl, pyrrolyl, pyrazolyl, pyridazinyl, triazinyl, pyrimidinyl, imidazolyl, pyrazinyl, purinyl, oxazolyl, isoxazolyl, thiazolyl, furyl, thienyl, pyridyl, pyrimidyl, benzothiazolyl, benzoxazoyl benzimidazolyl, benzofuran, isobenzofuranyl, indolyl, isoindolyl, benzothiophenyl, isoquinolyl, quinoxalinyl, quinolyl, 1-naphthyl, 2-naphthyl, 4-biphenyl, 1-pyrrolyl, 2-pyrrolyl, 3-pyrrolyl, 3-pyrazolyl, 2-imidazolyl, 4-imidazolyl, pyrazinyl, 2-oxazolyl, 4-oxazolyl, 2-phenyl-4-oxazolyl, 5-oxazolyl, 3-isoxazolyl, 4-isoxazolyl, 5-isoxazolyl, 2-thiazolyl, 4-thiazolyl, 5-thiazolyl, 2-furyl, 3-furyl, 2-thienyl, 3-thienyl, 2-pyridyl, 3-pyridyl, 4-pyridyl, 2-pyrimidyl, 4-pyrimidyl, 5-benzothiazolyl, purinyl, 2-benzimidazolyl, 5-indolyl, 1-isoquinolyl, 5-isoquinolyl, 2-quinoxalinyl, 5-quinoxalinyl, 3-quinolyl, and 6-quinolyl. Substituents for each of the above noted aryl and heteroaryl ring systems are selected from the group of acceptable substituents described below. An "arylene" and a "heteroarylene," alone or as part of another substituent, mean a divalent radical derived from an aryl and heteroaryl, respectively. A heteroaryl group substituent may be —O— bonded to a ring heteroatom nitrogen.

Spirocyclic rings are two or more rings wherein adjacent rings are attached through a single atom. The individual rings within spirocyclic rings may be identical or different. Individual rings in spirocyclic rings may be substituted or unsubstituted and may have different substituents from other individual rings within a set of spirocyclic rings. Possible substituents for individual rings within spirocyclic rings are the possible substituents for the same ring when not part of spirocyclic rings (e.g. substituents for cycloalkyl or heterocycloalkyl rings). Spirocyclic rings may be substituted or unsubstituted cycloalkyl, substituted or unsubstituted cycloalkylene, substituted or unsubstituted heterocycloalkyl or substituted or unsubstituted heterocycloalkylene and individual rings within a spirocyclic ring group may be any of the immediately previous list, including having all rings of one type (e.g. all rings being substituted heterocycloalkylene wherein each ring may be the same or different substituted heterocycloalkylene). When referring to a spirocyclic ring system, heterocyclic spirocyclic rings means a spirocyclic rings wherein at least one ring is a heterocyclic ring and wherein each ring may be a different ring. When referring to a spirocyclic ring system, substituted spirocyclic rings means that at least one ring is substituted and each substituent may optionally be different.

The symbol " ∼∼∼ " denotes the point of attachment of a chemical moiety to the remainder of a molecule or chemical formula.

The term "oxo," as used herein, means an oxygen that is double bonded to a carbon atom.

The term "alkylarylene" as an arylene moiety covalently bonded to an alkylene moiety (also referred to herein as an alkylene linker). In embodiments, the alkylarylene group has the formula:

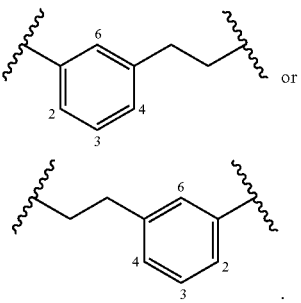

An alkylarylene moiety may be substituted (e.g. with a substituent group) on the alkylene moiety or the arylene linker (e.g. at carbons 2, 3, 4, or 6) with halogen, oxo, —N$_3$, —CF$_3$, —CCl$_3$, —CBr$_3$, —CI$_3$, —CN, —CHO, —OH, —NH$_2$, —COOH, —CONH$_2$, —NO$_2$, —SH, —SO$_2$CH$_3$ —SO$_3$H, —OSO$_3$H, —SO$_2$NH$_2$, —NHNH$_2$, —ONH$_2$, —NHC(O)NHNH$_2$, substituted or unsubstituted C$_1$-C$_5$ alkyl or substituted or unsubstituted 2 to 5 membered heteroalkyl). In embodiments, the alkylarylene is unsubstituted.

Each of the above terms (e.g., "alkyl," "heteroalkyl," "cycloalkyl," "heterocycloalkyl," "aryl," and "heteroaryl") includes both substituted and unsubstituted forms of the indicated radical. Preferred substituents for each type of radical are provided below.

Substituents for the alkyl and heteroalkyl radicals (including those groups often referred to as alkylene, alkenyl, heteroalkylene, heteroalkenyl, alkynyl, cycloalkyl, heterocycloalkyl, cycloalkenyl, and heterocycloalkenyl) can be one or more of a variety of groups selected from, but not limited to, —OR', =O, =NR', =N—OR', —NR'R", —SR', -halogen, —SiR'R"R'", —OC(O)R', —C(O)R', —CO$_2$R', —CONR'R", —OC(O)NR'R", —NR"C(O)R', —NR'—C(O)NR"R'", —NR"C(O)$_2$R', —NR—C(NR'R"R'")=NR"", —NR—C(NR'R")=NR'", —S(O)R', —S(O)$_2$R', —S(O)$_2$NR'R", —NRSO$_2$R', —NR'NR"R'", —ONR'R", —NR'C(O)NR"NR'"R"", —CN, —NO$_2$, —NR'SO$_2$R", —NR'C(O)R", —NR'C(O)—OR", —NR'OR", in a number ranging from zero to (2m'+1), where m' is the total number of carbon atoms in such radical. R, R', R", R'", and R"" each preferably independently refer to hydrogen, substituted or unsubstituted heteroalkyl, substituted or unsubstituted cycloalkyl, substituted or unsubstituted heterocycloalkyl, substituted or unsubstituted aryl (e.g., aryl substituted with 1-3 halogens), substituted or unsubstituted heteroaryl, substituted or unsubstituted alkyl, alkoxy, or thioalkoxy groups, or arylalkyl groups. When a compound described herein includes more than one R group, for example, each of the R groups is independently selected as are each R', R", R'", and R"" group when more than one of these groups is present. When R' and R" are attached to the same nitrogen atom, they can be combined with the nitrogen atom to form a 4-, 5-, 6-, or 7-membered ring. For example, —NR'R" includes, but is not limited to, 1-pyrrolidinyl and 4-morpholinyl. From the above discussion of substituents, one of skill in the art will understand that the term "alkyl" is meant to include groups including carbon atoms bound to groups other than hydrogen groups, such as haloalkyl (e.g., —CF$_3$ and —CH$_2$CF$_3$) and acyl (e.g., —C(O)CH$_3$, —C(O)CF$_3$, —C(O)CH$_2$OCH$_3$, and the like).

Similar to the substituents described for the alkyl radical, substituents for the aryl and heteroaryl groups are varied and are selected from, for example: —OR', —NR'R", —SR', -halogen, —SiR'R"R'", —OC(O)R', —C(O)R', —CO$_2$R', —CONR'R", —OC(O)NR'R", —NR"C(O)R', —NR'—C(O)NR"R'", —NR"C(O)$_2$R', —NR—C(NR'R"R'")=NR"", —NR—C(NR'R")=NR'", —S(O)R', —S(O)$_2$R', —S(O)$_2$NR'R", —NRSO$_2$R', —NR'NR"R'", —ONR'R", —NR'C(O)NR"NR'"R"", —CN, —NO$_2$, —R', —N$_3$, —CH(Ph)$_2$, fluoro(C$_1$-C$_4$)alkoxy, and fluoro(C$_1$-C$_4$)alkyl, —NR'SO$_2$R", —NR'C(O)R", —NR'C(O)—OR", —NR'OR", in a number ranging from zero to the total number of open valences on the aromatic ring system; and where R', R", R'", and R"" are preferably independently selected from hydrogen, substituted or unsubstituted alkyl, substituted or unsubstituted heteroalkyl, substituted or unsubstituted cycloalkyl, substituted or unsubstituted heterocycloalkyl, substituted or unsubstituted aryl, and substituted or unsubstituted heteroaryl. When a compound described herein includes more than one R group, for example, each of the R groups is independently selected as are each R', R", R'", and R"" groups when more than one of these groups is present.

Substituents for rings (e.g. cycloalkyl, heterocycloalkyl, aryl, heteroaryl, cycloalkylene, heterocycloalkylene, arylene, or heteroarylene) may be depicted as substituents on the ring rather than on a specific atom of a ring (commonly referred to as a floating substituent). In such a case, the substituent may be attached to any of the ring atoms (obeying the rules of chemical valency) and in the case of fused rings or spirocyclic rings, a substituent depicted as associated with one member of the fused rings or spirocyclic rings (a floating substituent on a single ring), may be a substituent on any of the fused rings or spirocyclic rings (a floating substituent on multiple rings). When a substituent is attached to a ring, but not a specific atom (a floating substituent), and a subscript for the substituent is an integer greater than one, the multiple substituents may be on the same atom, same ring, different atoms, different fused rings, different spirocyclic rings, and each substituent may optionally be different. Where a point of attachment of a ring to the remainder of a molecule is not limited to a single atom (a floating substituent), the attachment point may be any atom of the ring and in the case of a fused ring or spirocyclic ring, any atom of any of the fused rings or spirocyclic rings while obeying the rules of chemical valency. Where a ring, fused rings, or spirocyclic rings contain one or more ring heteroatoms and the ring, fused rings, or spirocyclic rings are shown with one more floating substituents (including, but not limited to, points of attachment to the remainder of the molecule), the floating substituents may be bonded to the heteroatoms. Where the ring heteroatoms are shown bound to one or more hydrogens (e.g. a ring nitrogen with two bonds to ring atoms and a third bond to a hydrogen) in the structure or formula with the floating substituent, when the heteroatom is bonded to the floating substituent, the substituent will be understood to replace the hydrogen, while obeying the rules of chemical valency.

Two or more substituents may optionally be joined to form aryl, heteroaryl, cycloalkyl, or heterocycloalkyl groups. Such so-called ring-forming substituents are typically, though not necessarily, found attached to a cyclic base structure. In one embodiment, the ring-forming substituents are attached to adjacent members of the base structure. For example, two ring-forming substituents attached to adjacent members of a cyclic base structure create a fused ring structure. In another embodiment, the ring-forming substituents are attached to a single member of the base structure. For example, two ring-forming substituents attached to a single member of a cyclic base structure create a spirocyclic structure. In yet another embodiment, the ring-forming substituents are attached to non-adjacent members of the base structure.

As used herein, the terms "heteroatom" or "ring heteroatom" are meant to include oxygen (O), nitrogen (N), sulfur (S), phosphorus (P), and silicon (Si).

The term "non-covalent linker" is used in accordance with its ordinary meaning and refers to a divalent moiety which includes at least two molecules that are not covalently linked to each other but are capable of interacting with each other via a non-covalent bond (e.g. electrostatic interactions (e.g. ionic bond, hydrogen bond, halogen bond) or van der Waals interactions (e.g. dipole-dipole, dipole-induced dipole, London dispersion). In embodiments, the non-covalent linker is the result of two molecules that are not covalently linked to each other that interact with each other via a non-covalent bond.

The term "anchor moiety" as used herein refers to a chemical moiety capable of interacting (e.g., covalently or non-covalently) with a second, optionally different, chemical moiety (e.g., complementary anchor moiety binder). In embodiments, the anchor moiety is a bioconjugate reactive group capable of interacting (e.g., covalently) with a complementary bioconjugate reactive group (e.g., complementary anchor moiety reactive group). In embodiments, an anchor moiety is a click chemistry reactant moiety. In embodiments, the anchor moiety (an "affinity anchor moiety") is capable of non-covalently interacting with a second chemical moiety (e.g., complementary affinity anchor moiety binder). Non-limiting examples of an anchor moiety include biotin, azide, trans-cyclooctene (TCO) and phenyl boric acid (PBA). In embodiments, an affinity anchor moiety (e.g., biotin moiety) interacts non-covalently with a complementary affinity anchor moiety binder (e.g., streptavidin moiety). In embodiments, an anchor moiety (e.g., azide moiety, trans-cyclooctene (TCO) moiety, phenyl boric acid (PBA) moiety) covalently binds a complementary anchor moiety binder (e.g., dibenzocyclooctyne (DBCO) moiety, tetrazine (TZ) moiety, salicylhydroxamic acid (SHA) moiety).

The terms "cleavable linker" or "cleavable moiety" as used herein refers to a divalent or monovalent, respectively, moiety which is capable of being separated (e.g., detached, split, disconnected, hydrolyzed, a stable bond within the moiety is broken) into distinct entities. A cleavable linker is cleavable (e.g., specifically cleavable) in response to external stimuli (e.g., enzymes, nucleophilic/basic reagents, reducing agents, photo-irradiation, electrophilic/acidic reagents, organometallic and metal reagents, or oxidizing reagents). A chemically cleavable linker refers to a linker which is capable of being split in response to the presence of a chemical (e.g., acid, base, oxidizing agent, reducing agent, Pd(0), tris-(2-carboxyethyl)phosphine, dilute nitrous acid, fluoride, tris(3-hydroxypropyl)phosphine), sodium dithionite ($Na_2S_2O_4$), hydrazine ($N_2H_4$)). A chemically cleavable linker is non-enzymatically cleavable. In embodiments, the cleavable linker is cleaved by contacting the cleavable linker with a cleaving agent. In embodiments, the cleaving agent is sodium dithionite ($Na_2S_2O_4$), weak acid, hydrazine ($N_2H_4$), Pd(0), or light-irradiation (e.g., ultraviolet radiation).

A photocleavable linker (e.g., including or consisting of a o-nitrobenzyl group) refers to a linker which is capable of being split in response to photo-irradiation (e.g., ultraviolet radiation). An acid-cleavable linker refers to a linker which is capable of being split in response to a change in the pH (e.g., increased acidity). A base-cleavable linker refers to a linker which is capable of being split in response to a change in the pH (e.g., decreased acidity). An oxidant-cleavable linker refers to a linker which is capable of being split in response to the presence of an oxidizing agent. A reductant-cleavable linker refers to a linker which is capable of being split in response to the presence of an reducing agent (e.g., Tris(3-hydroxypropyl)phosphine). In embodiments, the cleavable linker is a dialkylketal linker, an azo linker, an allyl linker, a cyanoethyl linker, a 1-(4,4-dimethyl-2,6-dioxocyclohex-1-ylidene)ethyl linker, or a nitrobenzyl linker.

The term "orthogonally cleavable linker" or "orthogonal cleavable linker" as used herein refer to a cleavable linker that is cleaved by a first cleaving agent (e.g., enzyme, nucleophilic/basic reagent, reducing agent, photo-irradiation, electrophilic/acidic reagent, organometallic and metal reagent, oxidizing reagent) in a mixture of two or more different cleaving agents and is not cleaved by any other different cleaving agent in the mixture of two or more cleaving agents. For example, two different cleavable linkers are both orthogonal cleavable linkers when a mixture of the two different cleavable linkers are reacted with two different cleaving agents and each cleavable linker is cleaved by only one of the cleaving agents and not the other cleaving agent. In embodiments, an orthogonally is a cleavable linker that following cleavage the two separated entities (e.g., fluorescent dye, bioconjugate reactive group) do not further react and form a new orthogonally cleavable linker.

The term "orthogonal binding group" or "orthogonal binding molecule" as used herein refer to a binding group (e.g. anchor moiety or complementary anchor moiety binder) that is capable of binding a first complementary binding group (e.g., complementary anchor moiety binder or anchor moiety) in a mixture of two or more different complementary binding groups and is unable to bind any other different complementary binding group in the mixture of two or more complementary binding groups. For example, two different binding groups are both orthogonal binding groups when a mixture of the two different binding groups are reacted with two complementary binding groups and each binding group binds only one of the complementary binding groups and not the other complementary binding group. An example of a set of four orthogonal binding groups and a set of orthogonal complementary binding groups are the binding groups biotin, azide, trans-cyclooctene (TCO) and phenyl boric acid (PBA), which specifically and efficiently bind or react with the complementary binding groups streptavidin, dibenzocyclooctyne (DBCO), tetrazine (TZ) and salicylhydroxamic acid (SHA) respectively.

The term "orthogonal detectable label" or "orthogonal detectable moiety" as used herein refer to a detectable label (e.g. fluorescent dye or detectable dye) that is capable of being detected and identified (e.g., by use of a detection means (e.g., emission wavelength, physical characteristic measurement)) in a mixture or a panel (collection of separate samples) of two or more different detectable labels. For example, two different detectable labels that are fluorescent dyes are both orthogonal detectable labels when a panel of the two different fluorescent dyes is subjected to a wavelength of light that is absorbed by one fluorescent dye but not the other and results in emission of light from the fluorescent dye that absorbed the light but not the other fluorescent dye. Orthogonal detectable labels may be separately identified by different absorbance or emission intensities of the orthogonal detectable labels compared to each other and not only be the absolute presence of absence of a signal. An example of a set of four orthogonal detectable labels is the set of Rox-Labeled Tetrazine, Alexa488-Labeled SHA, Cy5-Labeled Streptavidin, and R6G-Labeled Dibenzocyclooctyne.

The term "polymerase-compatible cleavable moiety" as used herein refers a cleavable moiety which does not interfere with the function of a polymerase (e.g., DNA polymerase, modified DNA polymerase). Methods for determining the function of a polymerase contemplated herein are described in B. Rosenblum et al. (Nucleic Acids Res. 1997 Nov. 15; 25(22): 4500-4504); and Z. Zhu et al. (Nucleic Acids Res. 1994 Aug. 25; 22(16): 3418-3422), which are incorporated by reference herein in their entirety for all purposes. In embodiments the polymerase-compatible cleavable moiety does not decrease the function of a polymerase relative to the absence of the polymerase-compatible cleavable moiety. In embodiments, the polymerase-compatible cleavable moiety does not negatively affect DNA polymerase recognition. In embodiments, the polymerase-com-patible cleavable moiety does not negatively affect (e.g., limit) the read length of the DNA polymerase. Additional examples of a polymerase-compatible cleavable moiety may be found in U.S. Pat. No. 6,664,079, Ju J. et al. (2006) Proc Natl Acad Sci USA 103(52):19635-19640; Ruparel H. et al. (2005) Proc Natl Acad Sci USA 102(17):5932-5937; Wu J. et al. (2007) Proc Natl Acad Sci USA 104(104):16462-16467; Guo J. et al. (2008) Proc Natl Acad Sci USA 105(27): 9145-9150 Bentley D. R. et al. (2008) Nature 456(7218): 53-59; or Hutter D. et al. (2010) Nucleosides Nucleotides & Nucleic Acids 29:879-895, which are incorporated herein by reference in their entirety for all purposes. In embodiments, a polymerase-compatible cleavable moiety includes an azido moiety or a dithiol linking moiety. In embodiments, the polymerase-compatible cleavable moiety is $-NH_2$, $-CN$, $-CH_3$, $C_2$-$C_6$ allyl (e.g., $-CH_2-CH=CH_2$), methoxyalkyl (e.g., $-CH_2-O-CH_3$), or $CH_2N_3$. In embodiments, the polymerase-compatible cleavable moiety comprises a disulfide moiety.

The term "allyl" as described herein refers to an unsubstituted methylene attached to a vinyl group (i.e. $-CH=CH_2$), having the formula

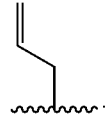

An "allyl linker" refers to a divalent unsubstituted methylene attached to a vinyl group, having the formula

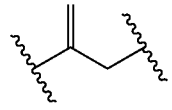

A "detectable agent" or "detectable compound" or "detectable label" or "detectable moiety" is a composition detectable by spectroscopic, photochemical, biochemical, immunochemical, chemical, magnetic resonance imaging, or other physical means. For example, detectable agents include $^{18}F$, $^{32}P$, $^{33}P$, $^{45}Ti$, $^{47}Sc$, $^{52}Fe$, $^{59}Fe$, $^{62}Cu$, $^{64}Cu$, $^{67}Cu$, $^{67}Ga$, $^{68}Ga$, $^{77}As$, $^{86}Y$, $^{90}Y$, $^{89}Sr$, $^{89}Zr$, $^{94}Tc$, $^{94}Tc$, $^{99m}Tc$, $^{99}Mo$, $^{105}Pd$, $^{105}Rh$, $^{111}Ag$, $^{111}In$, $^{123}I$, $^{124}I$, $^{125}I$, $^{131}I$, $^{142}Pr$, $^{143}Pr$, $^{149}Pm$, $^{153}Sm$, $^{154-158}Gd$, $^{161}Tb$, $^{166}Dy$, $^{166}Ho$, $^{169}Er$, $^{175}Lu$, $^{177}Lu$, $^{186}Re$, $^{188}Re$, $^{189}Re$, $^{194}Ir$, $^{198}Au$, $^{199}Au$, $^{211}At$, $^{211}Pb$, $^{212}Bi$, $^{212}Pb$, $^{213}Bi$, $^{223}Ra$, $^{225}Ac$, Cr, V, Mn, Fe, Co, Ni, Cu, La, Ce, Pr, Nd, Pm, Sm, Eu, Gd, Tb, Dy, Ho, Er, Tm, Yb, Lu, $^{32}P$, fluorophore (e.g. fluorescent dyes), modified oligonucleotides (e.g., moieties described in PCT/US2015/022063, which is incorporated herein by reference), electron-dense reagents, enzymes (e.g., as commonly used in an ELISA), biotin, digoxigenin, paramagnetic molecules, paramagnetic nanoparticles, ultrasmall superparamagnetic iron oxide ("USPIO") nanoparticles, USPIO nanoparticle aggregates, superparamagnetic iron oxide ("SPIO") nanoparticles, SPIO nanoparticle aggregates, monochrystalline iron oxide nanoparticles, monochrystalline iron oxide, nanoparticle contrast agents, liposomes or other delivery vehicles containing Gadolinium chelate ("Gd-chelate") molecules, Gadolinium, radioisotopes, radionuclides (e.g. carbon-11, nitrogen-13, oxygen-15, fluorine-18, rubidium-82), fluorodeoxyglucose (e.g. fluorine-18 labeled), any gamma ray emitting radionuclides, positron-emitting radionuclide, radiolabeled glucose, radiolabeled water, radiolabeled ammonia, biocolloids, microbubbles (e.g. including microbubble shells including albumin, galactose, lipid, and/or polymers; microbubble gas core including air, heavy gas(es), perfluorcarbon, nitrogen, octafluoropropane, perflexane lipid microsphere, perflutren, etc.), iodinated contrast agents (e.g. iohexol, iodixanol, ioversol, iopamidol, ioxilan, iopromide, diatrizoate, metrizoate, ioxaglate), barium sulfate, thorium dioxide, gold, gold nanoparticles, gold nanoparticle aggregates, fluorophores, two-photon fluorophores, or haptens and proteins or other entities which can be made detectable, e.g., by incorporating a radiolabel into a peptide or antibody specifically reactive with a target peptide.

Radioactive substances (e.g., radioisotopes) that may be used as imaging and/or labeling agents in accordance with the embodiments of the disclosure include, but are not limited to, $^{18}$F, $^{32}$P, $^{33}$P, $^{45}$Ti, $^{47}$Sc, $^{52}$Fe, $^{59}$Fe, $^{62}$Cu, $^{64}$Cu, $^{67}$Cu, $^{67}$Ga, $^{68}$Ga, $^{77}$As, $^{86}$Y, $^{90}$Y, $^{89}$Sr, $^{89}$Zr, $^{94}$Tc, $^{94}$Tc, $^{99m}$Tc, $^{99}$Mo, $^{105}$Pd, $^{105}$Rh, $^{111}$Ag, $^{111}$In, $^{123}$I, $^{124}$I, $^{154}$I, $^{131}$I, $^{142}$Pr, $^{143}$Pr, $^{149}$Pm, $^{153}$Sm, $^{154-158 1}$Gd, $^{161}$Tb $^{166}$Dy, $^{166}$Ho, $^{169}$Er, $^{175}$Lu, $^{177}$Lu, $^{186}$Re, $^{188}$Re, $^{189}$Re, $^{194}$Ir, $^{198}$Au, $^{199}$Au, $^{211}$At, $^{211}$Pb, $^{212}$Bi, $^{212}$Pb, $^{213}$Bi, $^{223}$Ra and $^{225}$Ac. Paramagnetic ions that may be used as additional imaging agents in accordance with the embodiments of the disclosure include, but are not limited to, ions of transition and lanthanide metals (e.g. metals having atomic numbers of 21-29, 42, 43, 44, or 57-71). These metals include ions of Cr, V, Mn, Fe, Co, Ni, Cu, La, Ce, Pr, Nd, Pm, Sm, Eu, Gd, Tb, Dy, Ho, Er, Tm, Yb and Lu.

Examples of detectable agents include imaging agents, including fluorescent and luminescent substances, including, but not limited to, a variety of organic or inorganic small molecules commonly referred to as "dyes," "labels," or "indicators." Examples include fluorescein, rhodamine, acridine dyes, Alexa dyes, and cyanine dyes. In embodiments, the detectable moiety is a fluorescent molecule (e.g., acridine dye, cyanine, dye, fluorine dye, oxazine dye, phenanthridine dye, or rhodamine dye). In embodiments, the detectable moiety is a fluorescent molecule (e.g., acridine dye, cyanine, dye, fluorine dye, oxazine dye, phenanthridine dye, or rhodamine dye). In embodiments, the detectable moiety is a fluorescein isothiocyanate moiety, tetramethylrhodamine-5-(and 6)-isothiocyanate moiety, Cy2 moeity, Cy3 moiety, Cy5 moiety, Cy7 moiety, 4',6-diamidino-2-phenylindole moiety, Hoechst 33258 moiety, Hoechst 33342 moiety, Hoechst 34580 moiety, propidium-iodide moiety, or acridine orange moiety. In embodiments, the detectable moiety is a Indo-1, Ca saturated moiety, Indo-1 Ca2+ moiety, Cascade Blue BSA pH 7.0 moiety, Cascade Blue moiety, LysoTracker Blue moiety, Alexa 405 moiety, LysoSensor Blue pH 5.0 moiety, LysoSensor Blue moiety, DyLight 405 moiety, DyLight 350 moiety, BFP (Blue Fluorescent Protein) moiety, Alexa 350 moiety, 7-Amino-4-methylcoumarin pH 7.0 moiety, Amino Coumarin moiety, AMCA conjugate moiety, Coumarin moiety, 7-Hydroxy-4-methylcoumarin moiety, 7-Hydroxy-4-methylcoumarin pH 9.0 moiety, 6,8-Difluoro-7-hydroxy-4-methylcoumarin pH 9.0 moiety, Hoechst 33342 moiety, Pacific Blue moiety, Hoechst 33258 moiety, Hoechst 33258-DNA moiety, Pacific Blue antibody conjugate pH 8.0 moiety, PO-PRO-1 moiety, PO-PRO-1-DNA moiety, POPO-1 moiety, POPO-1-DNA moiety, DAPI-DNA moiety, DAPI moiety, Marina Blue moiety, SYTOX Blue-DNA moiety, CFP (Cyan Fluorescent Protein) moiety, eCFP (Enhanced Cyan Fluorescent Protein) moiety, 1-Anilinonaphthalene-8-sulfonic acid (1,8-ANS) moiety, Indo-1, Ca free moiety, 1,8-ANS (1-Anilinonaphthalene-8-sulfonic acid) moiety, BO-PRO-1-DNA moiety, BOPRO-1 moiety, BOBO-1-DNA moiety, SYTO 45-DNA moiety, evoglow-Pp1 moiety, evoglow-Bs1 moiety, evoglow-Bs2 moiety, Auramine O moiety, DiO moiety, LysoSensor Green pH 5.0 moiety, Cy 2 moiety, LysoSensor Green moiety, Fura-2, high Ca moiety, Fura-2 Ca2+sup> moiety, SYTO 13-DNA moiety, YO-PRO-1-DNA moiety, YOYO-1-DNA moiety, eGFP (Enhanced Green Fluorescent Protein) moiety, LysoTracker Green moiety, GFP (S65T) moiety, BODIPY FL, MeOH moiety, Sapphire moiety, BODIPY FL conjugate moiety, MitoTracker Green moiety, MitoTracker Green FM, MeOH moiety, Fluorescein 0.1 M NaOH moiety, Calcein pH 9.0 moiety, Fluorescein pH 9.0 moiety, Calcein moiety, Fura-2, no Ca moiety, Fluo-4 moiety, FDA moiety, DTAF moiety, Fluorescein moiety, CFDA moiety, FITC moiety, Alexa Fluor 488 hydrazide-water moiety, DyLight 488 moiety, 5-FAM pH 9.0 moiety, Alexa 488 moiety, Rhodamine 110 moiety, Rhodamine 110 pH 7.0 moiety, Acridine Orange moiety, BCECF pH 5.5 moiety, PicoGreendsDNA quantitation reagent moiety, SYBR Green I moiety, Rhodaminen Green pH 7.0 moiety, CyQUANT GR-DNA moiety, NeuroTrace 500/525, green fluorescent Nissl stain-RNA moiety, DansylCadaverine moiety, Fluoro-Emerald moiety, Nissl moiety, Fluorescein dextran pH 8.0 moiety, Rhodamine Green moiety, 5-(and-6)-Carboxy-2',7'-dichlorofluorescein pH 9.0 moiety, DansylCadaverine, MeOH moiety, eYFP (Enhanced Yellow Fluorescent Protein) moiety, Oregon Green 488 moiety, Fluo-3 moiety, BCECF pH 9.0 moiety, SBFI-Na+ moiety, Fluo-3 Ca2+ moiety, Rhodamine 123 MeOH moiety, FlAsH moiety, Calcium Green-1 Ca2+ moiety, Magnesium Green moiety, DM-NERF pH 4.0 moiety, Calcium Green moiety, Citrine moiety, LysoSensor Yellow pH 9.0 moiety, TO-PRO-1-DNA moiety, Magnesium Green Mg2+ moiety, Sodium Green Na+ moiety, TOTO-1-DNA moiety, Oregon Green 514 moiety, Oregon Green 514 antibody conjugate pH 8.0 moiety, NBD-X moiety, DM-NERF pH 7.0 moiety, NBD-X, MeOH moiety, CI-NERF pH 6.0 moiety, Alexa 430 moiety, CI-NERF pH 2.5 moiety, *Lucifer* Yellow, CH moiety, LysoSensor Yellow pH 3.0 moiety, 6-TET, SE pH 9.0 moiety, Eosin antibody conjugate pH 8.0 moiety, Eosin moiety, 6-Carboxyrhodamine 6G pH 7.0 moiety, 6-Carboxyrhodamine 6G, hydrochloride moiety, Bodipy R6G SE moiety, BODIPY R6G MeOH moiety, 6 JOE moiety, Cascade Yellow moiety, mBanana moiety, Alexa 532 moiety, Erythrosin-5-isothiocyanate pH 9.0 moiety, 6-HEX, SE pH 9.0 moiety, mOrange moiety, mHoneydew moiety, Cy 3 moiety, Rhodamine B moiety, DiI moiety, 5-TAMRA-MeOH moiety, Alexa 555 moiety, DyLight 549 moiety, BODIPY TMR-X, SE moiety, BODIPY TMR-X MeOH moiety, PO-PRO-3-DNA moiety, PO-PRO-3 moiety, Rhodamine moiety, POPO-3 moiety, Alexa 546 moiety, Calcium Orange Ca2+ moiety, TRITC moiety, Calcium Orange moiety, Rhodaminephalloidin pH 7.0 moiety, MitoTracker Orange moiety, MitoTracker Orange MeOH moiety, Phycoerythrin moiety, Magnesium Orange moiety, R-Phycoerythrin pH 7.5 moiety, 5-TAMRA pH 7.0 moiety, 5-TAMRA moiety, Rhod-2 moiety, FM 1-43 moiety, Rhod-2 Ca2+ moiety, FM 1-43 lipid moiety, LOLO-1-DNA moiety, dTomato moiety, DsRed moiety, Dapoxyl (2-aminoethyl) sulfonamide moiety, Tetramethylrhodamine dextran pH 7.0 moiety, Fluor-Ruby moiety, Resorufin moiety, Resorufin pH 9.0 moiety, mTangerine moiety, LysoTracker Red moiety, Lissaminerhodamine moiety, Cy 3.5 moiety, Rhodamine Red-X antibody conjugate pH 8.0 moiety, Sulforhodamine 101 EtOH moiety, JC-1 pH 8.2 moiety, JC-1 moiety, mStrawberry moiety, MitoTracker Red moiety, MitoTracker Red, MeOH moiety, X-Rhod-1 Ca2+ moiety, Alexa 568 moiety, 5-ROX pH 7.0 moiety, 5-ROX (5-Carboxy-X-rhodamine, triethylammonium salt) moiety, BO-PRO-3-DNA moiety, BOPRO-3 moiety, BOBO-3-DNA moiety, Ethidium Bromide moiety, ReAsH moiety, Calcium Crimson moiety, Calcium Crimson Ca2+ moiety, mRFP moiety, mCherry moiety, HcRed moiety, DyLight 594 moiety, Ethidium homodimer-1-DNA moiety, Ethidiumhomodimer moiety, Propidium Iodide moiety, SYPRO Ruby moiety, Propidium Iodide-DNA moiety, Alexa 594 moiety, BODIPY TR-X, SE moiety, BODIPY TR-X, MeOH moiety, BODIPY TR-X phallacidin pH 7.0 moiety, Alexa Fluor 610 R-phycoerythrin streptavidin pH 7.2 moiety, YO-PRO-3-DNA moiety, Di-8 ANEPPS moiety, Di-8-ANEPPS-lipid moiety, YOYO-3-DNA moiety, Nile Red-lipid moiety, Nile Red moiety, DyLight 633 moiety, mPlum moiety, TO-PRO-3-DNA moiety, DDAO pH 9.0 moiety, Fura Red high Ca moiety, Allophycocyanin pH 7.5 moiety, APC (allophycocyanin) moiety, Nile Blue, EtOH moiety, TOTO-3-DNA moiety, Cy 5 moiety, BODIPY 650/665-X, MeOH moiety, Alexa Fluor 647 R-phycoerythrin streptavidin pH 7.2 moiety, DyLight 649 moiety, Alexa 647 moiety, Fura Red Ca2+ moiety, Atto 647 moiety, Fura Red, low Ca moiety, Carboxynaphthofluorescein pH 10.0 moiety, Alexa 660 moiety, Cy 5.5 moiety, Alexa 680 moiety, DyLight 680 moiety, Alexa 700 moiety, FM 4-64, 2% CHAPS moiety, or FM 4-64 moiety. In embodiments, the dectable moiety is a moiety of 1,1-Diethyl-4,4-carbocyanine iodide, 1,2-Diphenylacetylene, 1,4-Diphenylbutadiene, 1,4-Diphenylbutadiyne, 1,6-Diphenylhexatriene, 1,6-Diphenylhexatriene, 1-anilinonaphthalene-8-sulfonic acid, 2,7-Dichlorofluorescein, 2,5-DIPHENYLOXAZOLE, 2-Di-1-ASP, 2-dodecylresorufin, 2-Methylbenzoxazole, 3,3-Diethylthiadicarbocyanine iodide, 4-Dimethyl amino-4-Nitrostilbene, 5(6)-Carboxyfluorescein, 5(6)-Carboxynaphtofluorescein, 5(6)-Carboxytetramethyl-rhodamine B, 5-(and-6)-carboxy-2',7'-dichlorofluorescein, 5-(and-6)-carboxy-2,7-dichlorofluorescein, 5-(N-hexadecanoyl)aminoeosin, 5-(N-hexadecanoyl)aminoeosin, 5-chloromethylfluorescein, 5-FAM, 5-ROX, 5-TAMRA, 5-TAMRA, 6,8-difluoro-7-hydroxy-4-methylcoumarin, 6,8-difluoro-7-hydroxy-4-methylcoumarin, 6-carboxyrhodamine 6G, 6-HEX, 6-JOE, 6-JOE, 6-TET, 7-aminoactinomycin D, 7-Benzylamino-4-Nitrobenz-2-Oxa-1,3-Diazole, 7-Methoxycoumarin-4-Acetic Acid, 8-Benzyloxy-5,7-diphenylquinoline, 8-Benzyloxy-5,7-diphenylquinoline, 9,10-Bis(Phenylethynyl)Anthracene, 9,10-Diphenylanthracene, 9-METHYLCARBAZOLE, (CS)$_2$Ir(μ-Cl)$_2$Ir(CS)$_2$, AAA, Acridine Orange, Acridine Orange, Acridine Yellow, Acridine Yellow, Adams Apple Red 680, Adirondack Green 520, Alexa Fluor 350, Alexa Fluor 405, Alexa Fluor 430, Alexa Fluor 430, Alexa Fluor 480, Alexa Fluor 488, Alexa Fluor 488, Alexa Fluor 488 hydrazide, Alexa Fluor 500, Alexa Fluor 514, Alexa Fluor 532, Alexa Fluor 546, Alexa Fluor 546, Alexa Fluor 555, Alexa Fluor 555, Alexa Fluor 568, Alexa Fluor 594, Alexa Fluor 594, Alexa Fluor 594, Alexa Fluor 610, Alexa Fluor 610-R-PE, Alexa Fluor 633, Alexa Fluor 635, Alexa Fluor 647, Alexa Fluor 647, Alexa Fluor 647-R-PE, Alexa Fluor 660, Alexa Fluor 680, Alexa Fluor 680-APC, Alexa Fluor 680-R-PE, Alexa Fluor 700, Alexa Fluor 750, Alexa Fluor 790, Allophycocyanin, AmCyan1, Aminomethylcoumarin, Amplex Gold (product), Amplex Red Reagent, Amplex UltraRed, Anthracene, APC, APC-Seta-750, AsRed2, ATTO 390, ATTO 425, ATTO 430LS, ATTO 465, ATTO 488, ATTO 490LS, ATTO 495, ATTO 514, ATTO 520, ATTO 532, ATTO 550, ATTO 565, ATTO 590, ATTO 594, ATTO 610, ATTO 620, ATTO 633, ATTO 635, ATTO 647, ATTO 647N, ATTO 655, ATTO 665, ATTO 680, ATTO 700, ATTO 725, ATTO 740, ATTO Oxa12, ATTO Rho3B, ATTO Rho6G, ATTO Rho11, ATTO Rho12, ATTO Rho13, ATTO Rho14, ATTO Rho101, ATTO Thio12, Auramine O, Azami Green, Azami Green monomeric, B-phycoerythrin, BCECF, BCECF, Bex1, Biphenyl, Birch Yellow 580, Blue-green algae, BO-PRO-1, BO-PRO-3, BOBO-1, BOBO-3, BODIPY 630 650-X, BODIPY 650/665-X, BODIPY FL, BODIPY FL, BODIPY R6G, BODIPY TMR-X, BODIPY TR-X, BODIPY TR-X Ph 7.0, BODIPY TR-X phallacidin, BODIPY-DiMe, BODIPY-Phenyl, BODIPY-TMSCC, C3-Indocyanine, C3-Indocyanine, C3-Oxacyanine, C3-Thiacyanine Dye (EtOH), C3-Thiacyanine Dye (PrOH), C5-Indocyanine, C5-Oxacyanine, C5-Thiacyanine, C7-Indocyanine, C7-Oxacyanine, C545T, C-Phycocyanin, Calcein, Calcein red-orange, Calcium Crimson, Calcium Green-1, Calcium Orange, Calcofluor white 2MR, Carboxy SNARF-1 pH 6.0, Carboxy SNARF-1 pH 9.0, Carboxynaphthofluorescein, Cascade Blue, Cascade Yellow, Catskill Green 540, CBQCA, CellMask Orange, CellTrace BODIPY TR methyl ester, CellTrace calcein violet, CellTrace™ Far Red, CellTracker Blue, CellTracker Red CMTPX, CellTracker Violet BMQC, CF405M, CF405S, CF488A, CF543, CF555, CFP, CFSE, CF™ 350, CF™ 485, Chlorophyll A, Chlorophyll B, Chromeo 488, Chromeo 494, Chromeo 505, Chromeo 546, Chromeo 642, Citrine, Citrine, ClOH butoxy aza-BODIPY, ClOH C12 aza-BODIPY, CM-H2DCFDA, Coumarin 1, Coumarin 6, Coumarin 6, Coumarin 30, Coumarin 314, Coumarin 334, Coumarin 343, Coumarine 545T, Cresyl Violet Perchlorate, CryptoLight CF1, CryptoLight CF2, CryptoLight CF3, CryptoLight CF4, CryptoLight CF5, CryptoLight CF6, Crystal Violet, Cumarin153, Cy2, Cy3, Cy3, Cy3.5, Cy3B, Cy3B, Cy3Cy5 ET, Cy5, Cy5, Cy5.5, Cy7, Cyanine3 NHS ester, Cyanine5 carboxylic acid, Cyanine5 NHS ester, Cyclotella meneghiniana Kützing, CypHer5, CypHer5 pH 9.15, CyQUANT GR, CyTrak Orange, Dabcyl SE, DAF-FM, DAMC (Weiss), dansyl cadaverine, Dansyl Glycine (Dioxane), DAPI, DAPI, DAPI, DAPI, DAPI (DMSO), DAPI (H2O), Dapoxyl (2-aminoethyl)sulfonamide, DCI, DCM, DCM, DCM (acetonitrile), DCM (MeOH), DDAO, Deep Purple, di-8-ANEPPS, DiA, Dichlorotris(1,10-phenanthroline) ruthenium(II), DiClOH C12 aza-BODIPY, DiClOHbutoxy aza-BODIPY, DiD, DiI, DiICl8(3), DiO, DiR, Diversa Cyan-FP, Diversa Green-FP, DM-NERF pH 4.0, DOCI, Doxorubicin, DPP pH-Probe 590-7.5, DPP pH-Probe 590-9.0, DPP pH-Probe 590-11.0, DPP pH-Probe 590-11.0, Dragon Green, DRAQ5, DsRed, DsRed, DsRed, DsRed-Express, DsRed-Express2, DsRed-Express T1, dTomato, DY-350XL, DY-480, DY-480XL MegaStokes, DY-485, DY-485XL MegaStokes, DY-490, DY-490XL MegaStokes, DY-500, DY-500XL MegaStokes, DY-520, DY-520XL MegaStokes, DY-547, DY-549P1, DY-549P1, DY-554, DY-555, DY-557, DY-557, DY-590, DY-590, DY-615, DY-630, DY-631, DY-633, DY-635, DY-636, DY-647, DY-649P1, DY-649P1, DY-650, DY-651, DY-656, DY-673, DY-675, DY-676, DY-680, DY-681, DY-700, DY-701, DY-730, DY-731, DY-750, DY-751, DY-776, DY-782, Dye-28, Dye-33, Dye-45, Dye-304, Dye-1041, DyLight 488, DyLight 549, DyLight 594, DyLight 633, DyLight 649, DyLight 680, E2-Crimson, E2-Orange, E2-Red/Green, EBFP, ECF, ECFP, ECL Plus, eGFP, ELF 97, Emerald, Envy Green, Eosin, Eosin Y, epicocconone, EqFP611, Erythrosin-5-isothiocyanate, Ethidium bromide, ethidium homodimer-1, Ethyl Eosin, Ethyl Eosin, Ethyl Nile Blue A, Ethyl-p-Dimethylaminobenzoate, Ethyl-p-Dimethylaminobenzoate, Eu2O3 nanoparticles, Eu (Soini), Eu(tta) 3DEADIT, EvaGreen, EVOblue-30, EYFP, FAD, FITC, FITC, FlAsH, Flash Red EX, FlAsH-CCPGCC, FlAsH-CCXXCC, Fluo-3, Fluo-4, Fluo-5F, Fluorescein, Fluorescein 0.1 NaOH, Fluorescein-Dibase, fluoro-emerald, Fluorol 5G, FluoSpheres blue, FluoSpheres crimson, FluoSpheres dark red, FluoSpheres orange, FluoSpheres red, FluoSpheres yellow-green, FM4-64 in CTC, FM4-64 in SDS, FM 1-43, FM 4-64, Fort Orange 600, Fura Red, Fura Red Ca free, fura-2, Fura-2 Ca free, Gadodiamide, Gd-Dtpa-Bma, Gadodiamide, Gd-Dtpa-Bma, GelGreen™, GelRed™, H9-40, HcRed1, Hemo Red 720, HiLyte Fluor 488, HiLyte Fluor 555, HiLyte Fluor 647, HiLyte Fluor 680, HiLyte Fluor 750, HiLyte Plus 555, HiLyte Plus 647, HiLyte Plus 750, HmGFP, Hoechst 33258, Hoechst 33342, Hoechst-33258, Hoechst-33258, Hops Yellow 560, HPTS, HPTS, HPTS, HPTS, HPTS, indo-1, Indo-1 Ca free, Ir(Cn)2(acac), Ir(Cs)2(acac), IR-775 chloride, IR-806, Ir-OEP-CO-C1, IRDye® 650 Alkyne, IRDye® 650 Azide, IRDye® 650 Carboxylate, IRDye® 650 DBCO, IRDye® 650 Maleimide, IRDye® 650 NHS Ester, IRDye® 680LT Carboxylate, IRDye® 680LT Maleimide, IRDye® 680LT NHS Ester, IRDye® 680RD Alkyne, IRDye® 680RD Azide, IRDye® 680RD Carboxylate, IRDye® 680RD DBCO, IRDye® 680RD Maleimide, IRDye® 680RD NHS Ester, IRDye® 700 phosphoramidite, IRDye® 700DX, IRDye® 700DX, IRDye® 700DX Carboxylate, IRDye® 700DX NHS Ester, IRDye® 750 Carboxylate, IRDye® 750 Maleimide, IRDye® 750 NHS Ester, IRDye® 800 phosphoramidite, IRDye® 800CW, IRDye® 800CW Alkyne, IRDye® 800CW Azide, IRDye® 800CW Carboxylate, IRDye® 800CW DBCO, IRDye® 800CW Maleimide, IRDye® 800CW NHS Ester, IRDye® 800RS, IRDye® 800RS Carboxylate, IRDye® 800RS NHS Ester, IRDye® QC-1 Carboxylate, IRDye® QC-1 NHS Ester, *Isochrysis galbana*-Parke, JC-1, JC-1, JOJO-1, Jonamac Red Evitag T2, Kaede Green, Kaede Red, kusabira orange, Lake Placid 490, LDS 751, Lissamine Rhodamine (Weiss), LOLO-1, *lucifer* yellow CH, *Lucifer* Yellow CH, *lucifer* yellow CH, *Lucifer* Yellow CH Dilitium salt, Lumio Green, Lumio Red, Lumogen F Orange, Lumogen Red F300, Lumogen Red F300, LysoSensor Blue DND-192, LysoSensor Green DND-153, LysoSensor Green DND-153, LysoSensor Yellow/Blue DND-160 pH 3, LysoSensor YellowBlue DND-160, LysoTracker Blue DND-22, LysoTracker Blue DND-22, LysoTracker Green DND-26, LysoTracker Red DND-99, LysoTracker Yellow HCK-123, Macoun Red Evitag T2, Macrolex Fluorescence Red G, Macrolex Fluorescence Yellow 10GN, Macrolex Fluorescence Yellow 10GN, Magnesium Green, Magnesium Octaethylporphyrin, Magnesium Orange, Magnesium Phthalocyanine, Magnesium Phthalocyanine, Magnesium Tetramesitylporphyrin, Magnesium Tetraphenylporphyrin, malachite green isothiocyanate, Maple Red-Orange 620, Marina Blue, mBanana, mBBr, mCherry, Merocyanine 540, Methyl green, Methyl green, Methyl green, Methylene Blue, Methylene Blue, mHoneyDew, MitoTracker Deep Red 633, MitoTracker Green FM, MitoTracker Orange CMTMRos, MitoTracker Red CMXRos, monobromobimane, Monochlorobimane, Monoraphidium, mOrange, mOrange2, mPlum, mRaspberry, mRFP, mRFP1, mRFP1.2 (Wang), mStrawberry (Shaner), mTangerine (Shaner), N,N-Bis(2,4,6-trimethylphenyl)-3,4:9,10-perylenebis(dicarboximide), NADH, Naphthalene, Naphthalene, Naphthofluorescein, Naphthofluorescein, NBD-X, NeuroTrace 500525, Nilblau perchlorate, nile blue, Nile Blue, Nile Blue (EtOH), nile red, Nile Red, Nile Red, Nile red, Nileblue A, NIR1, NIR2, NIR3, NIR4, NIR820, Octaethylporphyrin, OH butoxy aza-BODIPY, OHC12 aza-BODIPY, Orange Fluorescent Protein, Oregon Green 488, Oregon Green 488 DHPE, Oregon Green 514, Oxazin1, Oxazin 750, Oxazine 1, Oxazine 170, P4-3, P-Quaterphenyl, P-Terphenyl, PA-GFP (post-activation), PA-GFP (pre-activation), Pacific Orange, Palladium (II) meso-tetraphenyl-tetrabenzoporphyrin, PdOEPK, PdTFPP, PerCP-Cy5.5, Perylene, Perylene, Perylene bisimide pH-Probe 550-5.0, Perylene bisimide pH-Probe 550-5.5, Perylene bisimide pH-Probe 550-6.5, Perylene Green pH-Probe 720-5.5, Perylene Green Tag pH-Probe 720-6.0, Perylene Orange pH-Probe 550-2.0, Perylene Orange Tag 550, Perylene Red pH-Probe 600-5.5, Perylenediimid, Perylene Green pH-Probe 740-5.5, Phenol, Phenylalanine, pHrodo, succinimidyl ester, Phthalocyanine, PicoGreen dsDNA quantitation reagent, Pinacyanol-Iodide, Piroxicam, Platinum(II) tetraphenyltetrabenzoporphyrin, Plum Purple, PO-PRO-1, PO-PRO-3, POPO-1, POPO-3, POPOP, Porphin, PPO, Proflavin, PromoFluor-350, PromoFluor-405, PromoFluor-415, PromoFluor-488, PromoFluor-488 Premium, PromoFluor-488LSS, PromoFluor-500LSS, PromoFluor-505, PromoFluor-510LSS, PromoFluor-514LSS, PromoFluor-520LSS, PromoFluor-532, PromoFluor-546, PromoFluor-555, PromoFluor-590, PromoFluor-610, PromoFluor-633, PromoFluor-647, PromoFluor-670, PromoFluor-680, PromoFluor-700, PromoFluor-750, PromoFluor-770, PromoFluor-780, PromoFluor-840, propidium iodide, Protoporphyrin IX, PTIR475/UF, PTIR545/UF, PtOEP, PtOEPK, PtTFPP, Pyrene, QD525, QD565, QD585, QD605, QD655, QD705, QD800, QD903, QD PbS 950, QDot 525, QDot 545, QDot 565, Qdot 585, Qdot 605, Qdot 625, Qdot 655, Qdot 705, Qdot 800, QpyMe2, QSY 7, QSY 7, QSY 9, QSY 21, QSY 35, quinine, Quinine Sulfate, Quinine sulfate, R-phycoerythrin, R-phycoerythrin, ReAsH-CCPGCC, ReAsH-CCXXCC, Red Beads (Weiss), Redmond Red, Resorufin, resorufin, rhod-2, Rhodamin 700 perchlorate, rhodamine, Rhodamine 6G, Rhodamine 6G, Rhodamine 101, rhodamine 110, Rhodamine 123, rhodamine 123, Rhodamine B, Rhodamine B, Rhodamine Green, Rhodamine pH-Probe 585-7.0, Rhodamine pH-Probe 585-7.5, Rhodamine phalloidin, Rhodamine Red-X, Rhodamine Red-X, Rhodamine Tag pH-Probe 585-7.0, Rhodol Green, Riboflavin, Rose Bengal, Sapphire, SBFI, SBFI Zero Na, *Scenedesmus* sp., SensiLight PBXL-1, SensiLight PBXL-3, Seta 633-NHS, Seta-633-NHS, SeTau-380-NHS, SeTau-647-NHS, Snake-Eye Red 900, SNIR1, SNIR2, SNIR3, SNIR4, Sodium Green, Solophenyl flavine 7GFE 500, Spectrum Aqua, Spectrum Blue, Spectrum FRed, Spectrum Gold, Spectrum Green, Spectrum Orange, Spectrum Red, Squarylium dye III, Stains All, Stilben derivate, Stilbene, Styryl8 perchlorate, Sulfo-Cyanine3 carboxylic acid, Sulfo-Cyanine3 carboxylic acid, Sulfo-Cyanine3 NHS ester, Sulfo-Cyanine5 carboxylic acid, Sulforhodamine 101, sulforhodamine 101, Sulforhodamine B, Sulforhodamine G, Suncoast Yellow, SuperGlo BFP, SuperGlo GFP, Surf Green EX, SYBR Gold nucleic acid gel stain, SYBR Green I, SYPRO Ruby, SYTO 9, SYTO 11, SYTO 13, SYTO 16, SYTO 17, SYTO 45, SYTO 59, SYTO 60, SYTO 61, SYTO 62, SYTO 82, SYTO RNASelect, SYTO RNASelect, SYTOX Blue, SYTOX Green, SYTOX Orange, SYTOX Red, T-Sapphire, Tb (Soini), tCO, tdTomato, Terrylen, Terrylendiimid, testdye, Tetra-t-Butylazaporphine, Tetra-t-Butylnaphthalocyanine, Tetracen, Tetrakis(o-Aminophenyl)Porphyrin, Tetramesitylporphyrin, Tetramethylrhodamine, tetramethylrhodamine, Tetraphenylporphyrin, Tetraphenylporphyrin, Texas Red, Texas Red DHPE, Texas Red-X, ThiolTracker Violet, Thionin acetate, TMRE, TO-PRO-1, TO-PRO-3, Toluene, Topaz (Tsien1998), TOTO-1, TOTO-3, Tris(2,2-Bipyridyl)Ruthenium(II) chloride, Tris(4,4-diphenyl-2,2-bipyridine) ruthenium(II) chloride, Tris(4,7-diphenyl-1,10-phenanthroline) ruthenium(II) TMS, TRITC (Weiss), TRITC Dextran (Weiss), Tryptophan, Tyrosine, Vex1, Vybrant DyeCycle Green stain, Vybrant DyeCycle Orange stain, Vybrant DyeCycle Violet stain, WEGFP (post-activation), WellRED D2, WellRED D3, WellRED D4, WtGFP, WtGFP (Tsien1998), X-rhod-1, Yakima Yellow, YFP, YO-PRO-1, YO-PRO-3, YOYO-1, YoYo-1, YoYo-1 dsDNA, YoYo-1 ssDNA, YOYO-3, Zinc Octaethylporphyrin, Zinc Phthalocyanine, Zinc Tetramesitylporphyrin, Zinc Tetraphenylporphyrin, ZsGreen1, or ZsYellow1.

In embodiments, the detectable label is a fluorescent dye. In embodiments, the detectable label is a fluorescent dye capable of exchanging energy with another fluorescent dye (e.g., fluorescence resonance energy transfer (FRET) chromophores).

In embodiments, the detectable moiety is a moiety of a derivative of one of the detectable moieties described immediately above, wherein the derivative differs from one of the detectable moieties immediately above by a modification resulting from the conjugation of the detectable moiety to a compound described herein.

The term "cyanine" or "cyanine moiety" as described herein refers to a detectable moiety containing two nitrogen groups separated by a polymethine chain. In embodiments, the cyanine moiety has 3 methine structures (i.e. cyanine 3 or Cy3). In embodiments, the cyanine moiety has 5 methine structures (i.e. cyanine 5 or Cy5). In embodiments, the cyanine moiety has 7 methine structures (i.e. cyanine 7 or Cy7).

Descriptions of nucleotide analogues of the present disclosure are limited by principles of chemical bonding known to those skilled in the art. Accordingly, where a group may be substituted by one or more of a number of substituents, such substitutions are selected so as to comply with principles of chemical bonding and to give compounds which are not inherently unstable and/or would be known to one of ordinary skill in the art as likely to be unstable under ambient conditions, such as aqueous, neutral, and several known physiological conditions. For example, a heterocycloalkyl or heteroaryl is attached to the remainder of the molecule via a ring heteroatom in compliance with principles of chemical bonding known to those skilled in the art thereby avoiding inherently unstable compounds.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are near each other, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid. The terms "non-naturally occurring amino acid" and "unnatural amino acid" refer to amino acid analogs, synthetic amino acids, and amino acid mimetics, which are not found in nature.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

The terms "polypeptide," "peptide" and "protein" are used interchangeably herein to refer to a polymer of amino acid residues, wherein the polymer may In embodiments be conjugated to a moiety that does not consist of amino acids. The terms apply to amino acid polymers in which one or more amino acid residue is an artificial chemical mimetic of a corresponding naturally occurring amino acid, as well as to naturally occurring amino acid polymers and non-naturally occurring amino acid polymers. A "fusion protein" refers to a chimeric protein encoding two or more separate protein sequences that are recombinantly expressed as a single moiety.

"Conservatively modified variants" applies to both amino acid and nucleic acid sequences. With respect to particular nucleic acid sequences, "conservatively modified variants" refers to those nucleic acids that encode identical or essentially identical amino acid sequences. Because of the degeneracy of the genetic code, a number of nucleic acid sequences will encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein, which encodes a polypeptide, also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid that encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the disclosure.

The following groups each contain amino acids that are conservative substitutions for one another: 1) Non-polar—Alanine (A), Leucine (L), Isoleucine (I), Valine (V), Glycine (G), Methionine (M); 2) Aliphatic—Alanine (A), Leucine (L), Isoleucine (I), Valine (V); 3) Acidic—Aspartic acid (D), Glutamic acid (E); 4) Polar—Asparagine (N), Glutamine (Q); Serine (S), Threonine (T); 5) Basic-Arginine (R), Lysine (K); 7) Aromatic—Phenylalanine (F), Tyrosine (Y), Tryptophan (W), Histidine (H); 8) Other—Cystein (C) and Proline (P).

The term "amino acid side chain" refers to the functional substituent contained on amino acids. For example, an amino acid side chain may be the side chain of a naturally occurring amino acid. Naturally occurring amino acids are those encoded by the genetic code (e.g., alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, or valine), as well as those amino acids that are later modified, e.g., hydroxyproline, γ-carboxyglutamate, and O-phosphoserine. In embodiments, the amino acid side chain may be a non-natural amino acid side chain. In embodiments, the amino acid side chain is H,

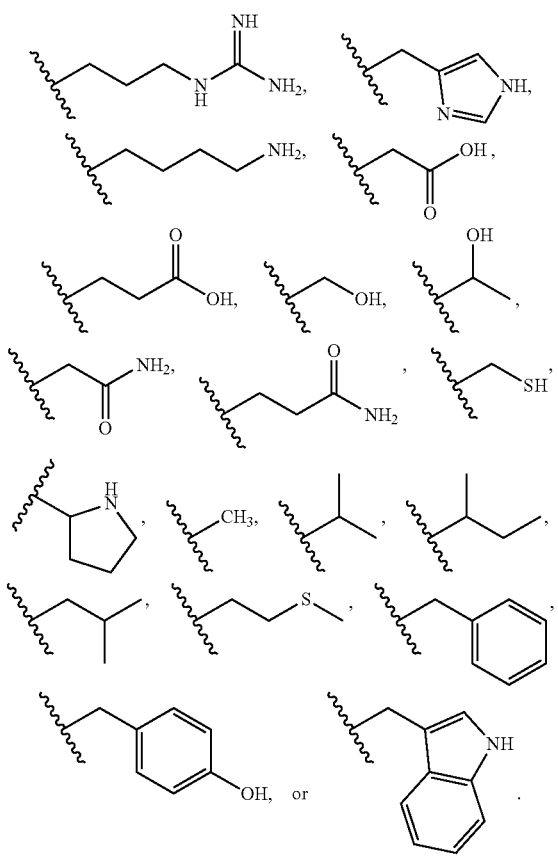

The term "non-natural amino acid side chain" refers to the functional substituent of compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium, allylalanine, 2-aminoisobutyric acid. Non-natural amino acids are non-proteinogenic amino acids that occur naturally or are chemically synthesized. Such analogs have modified R groups (e.g., norleucine) or modified peptide backbones, but retain the same basic chemical structure as a naturally occurring amino acid. Non-limiting examples include exo-cis-3-Aminobicyclo[2.2.1]hept-5-ene-2-carboxylic acid hydrochloride, cis-2-Aminocycloheptanecarboxylic acid hydrochloride,cis-6-Amino-3-cyclohexene-1-carboxylic acid hydrochloride, cis-2-Amino-2-methylcyclohexanecarboxylic acid hydrochloride, cis-2-Amino-2-methylcyclopentanecarboxylic acid hydrochloride, 2-(Boc-aminomethyl)benzoic acid, 2-(Boc-amino)octanedioic acid, Boc-4,5-dehydro-Leu-OH (dicyclohexylammonium), Boc-4-(Fmoc-amino)-L-phenylalanine, Boc-β-Homopyr-OH, Boc-(2-indanyl)-Gly-OH, 4-Boc-3-morpholineacetic acid, 4-Boc-3-morpholineacetic acid, Boc-pentafluoro-D-phenylalanine, Boc-pentafluoro-L-phenylalanine, Boc-Phe(2-Br)—OH, Boc-Phe(4-Br)—OH, Boc-D-Phe(4-Br)—OH, Boc-D-Phe(3-Cl)—OH, Boc-Phe(4-NH2)-OH, Boc-Phe(3-NO2)-OH, Boc-Phe(3,5-F2)-OH, 2-(4-Boc-piperazino)-2-(3,4-dimethoxyphenyl)acetic acid purum, 2-(4-Boc-piperazino)-2-(2-fluorophenyl)acetic acid purum, 2-(4-Boc-piperazino)-2-(3-fluorophenyl)acetic acid purum, 2-(4-Boc-piperazino)-2-(4-fluorophenyl)acetic acid purum, 2-(4-Boc-piperazino)-2-(4-methoxyphenyl)acetic acid purum, 2-(4-Boc-piperazino)-2-phenylacetic acid purum, 2-(4-Boc-piperazino)-2-(3-pyridyl)acetic acid purum, 2-(4-Boc-piperazino)-2-[4-(trifluoromethyl)phenyl] acetic acid purum, Boc-β-(2-quinolyl)-Ala-OH, N-Boc-1,2,3,6-tetrahydro-2-pyridinecarboxylic acid, Boc-β-(4-thiazolyl)-Ala-OH, Boc-β-(2-thienyl)-D-Ala-OH, Fmoc-N-(4-Boc-aminobutyl)-Gly-OH, Fmoc-N-(2-Boc-aminoethyl)-Gly-OH, Fmoc-N-(2,4-dimethoxybenzyl)-Gly-OH, Fmoc-(2-indanyl)-Gly-OH, Fmoc-pentafluoro-L-phenylalanine, Fmoc-Pen(Trt)-OH, Fmoc-Phe(2-Br)—OH, Fmoc-Phe(4-Br)—OH, Fmoc-Phe(3,5-F2)-OH, Fmoc-β-(4-thiazolyl)-Ala-OH, Fmoc-β-(2-thienyl)-Ala-OH, 4-(Hydroxymethyl)-D-phenylalanine.

"Percentage of sequence identity" is determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The terms "identical" or percent "identity," in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site www.ncbi.nlm.nih.gov/BLAST/ or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length. As used herein, percent (%) amino acid sequence identity is defined as the percentage of amino acids in a candidate sequence that are identical to the amino acids in a reference sequence, after aligning the sequences and introducing gaps, if necessary, to achieve the maximum percent sequence identity. Alignment for purposes of determining percent sequence identity can be achieved in various ways that are within the skill in the art, for instance, using publicly available computer software such as BLAST, BLAST-2, ALIGN, ALIGN-2 or Megalign (DNASTAR) software. Appropriate parameters for measuring alignment, including any algorithms needed to achieve maximal alignment over the full-length of the sequences being compared can be determined by known methods.

For sequence comparisons, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Preferably, default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 10 to 700, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

An amino acid or nucleotide base "position" is denoted by a number that sequentially identifies each amino acid (or nucleotide base) in the reference sequence based on its position relative to the N-terminus (or 5'-end). Due to deletions, insertions, truncations, fusions, and the like that must be taken into account when determining an optimal alignment, in general the amino acid residue number in a test sequence determined by simply counting from the N-terminus will not necessarily be the same as the number of its corresponding position in the reference sequence. For example, in a case where a variant has a deletion relative to an aligned reference sequence, there will be no amino acid in the variant that corresponds to a position in the reference sequence at the site of deletion. Where there is an insertion in an aligned reference sequence, that insertion will not correspond to a numbered amino acid position in the reference sequence. In the case of truncations or fusions there can be stretches of amino acids in either the reference or aligned sequence that do not correspond to any amino acid in the corresponding sequence.

The term "DNA polymerase" and "nucleic acid polymerase" are used in accordance with their plain ordinary meaning and refer to enzymes capable of synthesizing nucleic acid molecules from nucleotides (e.g., deoxyribonucleotides). Typically, a DNA polymerase adds nucleotides to the 3'-end of a DNA strand, one nucleotide at a time. In embodiments, the DNA polymerase is a Pol I DNA polymerase, Pol II DNA polymerase, Pol III DNA polymerase, Pol IV DNA polymerase, Pol V DNA polymerase, Pol β DNA polymerase, Pol μ DNA polymerase, Pol λ DNA polymerase, Pol σ DNA polymerase, Pol α DNA polymerase, Pol δ DNA polymerase, Pol ε DNA polymerase, Pol η DNA polymerase, Pol ι DNA polymerase, Pol κ DNA polymerase, Pol ζ DNA polymerase, Pol γ DNA polymerase, Pol θ DNA polymerase, Pol ν DNA polymerase, or a thermophilic nucleic acid polymerase (e.g. Terminator γ, 9° N polymerase (exo-), Therminator II, Therminator III, or Therminator IX).

The term "thermophilic nucleic acid polymerase" as used herein refers to a family of DNA polymerases (e.g., 9° N™) and mutants thereof derived from the DNA polymerase originally isolated from the hyperthermophilic archaea, *Thermococcus* sp. 9 degrees N-7, found in hydrothermal vents at that latitude (East Pacific Rise) (Southworth M W, et al. *PNAS.* 1996; 93(11):5281-5285). A thermophilic nucleic acid polymerase is a member of the family B DNA polymerases. Site-directed mutagenesis of the 3'-5' exo motif I (Asp-Ile-Glu or DIE) to AIA, AIE, EIE, EID or DIA yielded polymerase with no detectable 3' exonuclease activity. Mutation to Asp-Ile-Asp (DID) resulted in reduction of 3'-5' exonuclease specific activity to <1% of wild type, while maintaining other properties of the polymerase including its high strand displacement activity. The sequence AIA (D141A, E143A) was chosen for reducing exonuclease. Subsequent mutagenesis of key amino acids results in an increased ability of the enzyme to incorporate dideoxynucleotides, ribonucleotides and acyclonucleotides (e.g., Therminator II enzyme from New England Biolabs with D141A/E143A/Y409V/A485L mutations as shown in SEQ ID NO: 212); 3'-amino-dNTPs, 3'-azido-dNTPs and other 3'-modified nucleotides (e.g., NEB Therminator III DNA Polymerase with D141A/E143A/L408S/Y409A/P410V mutations as shown in SEQ ID NO: 213, NEB Therminator IX DNA polymerase), or γ-phosphate labeled nucleotides (e.g., Therminator γ: D141A/E143A/W355A/L408W/R460A/Q461S/K464E/D480V/R484W/A485L). Typically, these enzymes do not have 5'-3' exonuclease activity. Additional information about thermophilic nucleic acid polymerases may be found in (Southworth M W, et al. *PNAS.* 1996; 93(11):5281-5285; Bergen K, et al. *ChemBioChem.* 2013; 14(9):1058-1062; Kumar S, et al. *Scientific Reports.* 2012; 2:684; Fuller C W, et al. 2016; 113(19):5233-5238; Guo J, et al. *Proceedings of the National Academy of Sciences of the United States of America.* 2008; 105(27):9145-9150), which are incorporated herein in their entirety for all purposes.

The term "exonuclease activity" is used in accordance with its ordinary meaning in the art, and refers to the removal of a nucleotide from a nucleic acid by a DNA polymerase. For example, during polymerization, nucleotides are added to the 3' end of the primer strand. Occasionally a DNA polymerase incorporates an incorrect nucleotide to the 3'-OH terminus of the primer strand, wherein the incorrect nucleotide cannot form a hydrogen bond to the corresponding base in the template strand. Such a nucleotide, added in error, is removed from the primer as a result of the 3' to 5' exonuclease activity of the DNA polymerase. In embodiments, exonuclease activity may be referred to as "proofreading." When referring to 3'-5' exonuclease activity, it is understood that the DNA polymerase facilitates a hydrolyzing reaction that breaks phosphodiester bonds at either the 3' end of a polynucleotide chain to excise the nucleotide. In embodiments, 3'-5' exonuclease activity refers to the successive removal of nucleotides in single-stranded DNA in a 3'→5' direction, releasing deoxyribonucleoside 5'-monophosphates one after another. Methods for quantifying exonuclease activity are known in the art, see for example Southworth et al, PNAS Vol 93, 8281-8285 (1996).

The term "independently resolvable" means that the entity under study can be examined independent of other entities due to spatial separation, for example, one polymerase-template complex can be probed independent from another polymerase-template complex present at a different physical location, or "address", on the solid substrate.

The terms "measure", "measuring", "measurement" and the like refer not only to quantitative measurement of a particular variable, but also to qualitative and semi-quantitative measurements. Accordingly, "measurement" also includes detection, meaning that merely detecting a change, without quantification, constitutes measurement.

The term "population" refers to a collection of one or more entities, e.g., DNA molecules.

"Perfectly matched" in reference to a nucleic acid duplex means that the poly- or oligonucleotide strands making up the duplex form a double-stranded structure, or region of double-stranded structure, with one another such that every nucleotide (or nucleotide analogue) in each strand undergoes Watson-Crick base-pairing with a nucleotide in the other strand in the duplexed (i.e., hybridized) region. The term also comprehends the pairing of nucleoside analogues, such as deoxyinosine with deoxycytidine, and the like. Conversely, a "mismatch" in a nucleic acid duplex means that one or more pairs of nucleotides in the duplex fail to undergo Watson-Crick base-pairing.

A "polymerase-template complex" refers to functional complex between a DNA polymerase and a DNA primer-template molecule being sequenced.

The terms "sequencing", "sequence determination", "determining a nucleotide sequence", and the like include determination of partial as well as full sequence information of the polynucleotide being sequenced. That is, the term includes sequence comparisons, fingerprinting, and like levels of information about a target polynucleotide, as well as the express identification and ordering of nucleotides in a target polynucleotide. The term also includes the determination of the identification, ordering, and locations of one, two, or three of the four types of nucleotides within a target polynucleotide.

The term "sequencing reaction mixture" refers to an aqueous mixture that contains the reagents necessary to allow a dNTP or dNTP analogue to add a nucleotide to a DNA strand by a DNA polymerase.

The term "solid substrate" means any suitable medium present in the solid phase to which an antibody or an agent can be covalently or non-covalently affixed or immobilized. Preferred solid substrates are glass. Non-limiting examples include chips, beads and columns. The solid substrate can be non-porous or porous. Exemplary solid substrates include, but are not limited to, glass and modified or functionalized glass, plastics (including acrylics, polystyrene and copolymers of styrene and other materials, polypropylene, polyethylene, polybutylene, polyurethanes, Teflon™, cyclic olefins, polyimides, etc.), nylon, ceramics, resins, Zeonor, silica or silica-based materials including silicon and modified silicon, carbon, metals, inorganic glasses, optical fiber bundles, and polymers.

The term "species", when used in the context of describing a particular compound or molecule species, refers to a population of chemically indistinct molecules. When used in the context of taxonomy, "species" is the basic unit of classification and a taxonomic rank. For example, in reference to the microorganism *Pyrococcus abyssi*, *abyssi* is a species of the genus *Pyrococcus*.

The terms "position", "numbered with reference to" or "corresponding to," when used in the context of the numbering of a given amino acid or polynucleotide sequence, refer to the numbering of the residues of a specified reference sequence when the given amino acid or polynucleotide sequence is compared to the reference sequence. An amino acid residue in a protein "corresponds" to a given residue when it occupies the same essential structural position within the protein as the given residue. One skilled in the art will immediately recognize the identity and location of residues corresponding to a specific position in a protein (e.g., polymerase) in other proteins with different numbering systems. For example, by performing a simple sequence alignment with a protein (e.g., polymerase) the identity and location of residues corresponding to specific positions of said protein are identified in other protein sequences aligning to said protein. For example, a selected residue in a selected protein corresponds to methionine at position 129 when the selected residue occupies the same essential spatial or other structural relationship as a methionine at position 129. In some embodiments, where a selected protein is aligned for maximum homology with a protein, the position in the aligned selected protein aligning with methionine 129 said to correspond to methionine 129. Instead of a primary sequence alignment, a three dimensional structural alignment can also be used, e.g., where the structure of the selected protein is aligned for maximum correspondence with the methionine at position 129, and the overall structures compared. In this case, an amino acid that occupies the same essential position as methionine 129 in the structural model is said to correspond to the methionine 129 residue. For example, references to a *P. abyssi* polymerase amino acid position recited herein may refer to a numbered position set forth in SEQ ID NO:1, or the corresponding position in a polymerase homolog of SEQ ID NO:1. In embodiments, references to a polymerase amino acid position recited herein refers to a numbered position set forth in SEQ ID NO:1 which is the amino acid sequence of the wildtype *P. abyssi* polymerase. In embodiments, SEQ ID NO: 2-203, are all variants of *P. abyssi* polymerase with substitution, deletion, and/or addition mutations at amino acid positions referenced relative to wildtype *P. abyssi* polymerase with amino acid sequence of SEQ ID NO: 1. In embodiments, the polymerase provided herein may have one or more amino acid substitution mutations at position 129, 141, 142, 143, 144, 209, 210, 213, 214, 215, 274, 275, 311 and/or 315 where the numbering is in reference to the amino acid position as provided in SEQ ID NO: 1. In embodiments, the polymerase provided herein may include mutations at positions in a parent polymerase corresponding to positions in SEQ ID NO: 1 identified as follows: 141, 143, 215, and 315. In embodiments, the polymerase provided herein may include mutations at positions 141, 143, 215, and 315 corresponding to positions in SEQ ID NO: 1. In embodiments, the polymerase may include an amino acid substitution mutation at a particular position corresponding to a position in SEQ ID NO: 1. For example, in embodiments, the polymerase includes an amino acid substitution mutation at position 590, which means the variant polymerase has a different amino acid at position 590 compared to SEQ ID NO: 1. In embodiments, the polymerase includes an amino acid substitution mutation at more than one position compared to SEQ ID NO: 1. For example, in embodiments, the polymerase includes the following substitution mutations: M129A, D141A, T144A, E143A, L409A, Y410G, A486V, T515S, and T590I where the number refers to the corresponding position in SEQ ID NO: 1. One having skill in the art would understand the amino acid mutation nomenclature, such that M129A refers to methionine (single letter code is A), at position 129, is replaced with alanine (single letter code A).

The terms "agonist," "activator," "upregulator," etc. refer to a substance capable of detectably increasing the expression or activity of a given gene or protein. The agonist can increase expression or activity 10%, 20%, 30%, 40%, 50%, 60%, 70%, 80%, 90% or more in comparison to a control in the absence of the agonist. In certain instances, expression or activity is 1.5-fold, 2-fold, 3-fold, 4-fold, 5-fold, 10-fold or higher than the expression or activity in the absence of the agonist.

As defined herein, the term "inhibition", "inhibit", "inhibiting" and the like in reference to a protein-inhibitor interaction means negatively affecting (e.g. decreasing) the activity or function of the protein relative to the activity or function of the protein in the absence of the inhibitor. In embodiments inhibition means negatively affecting (e.g. decreasing) the concentration or levels of the protein relative to the concentration or level of the protein in the absence of the inhibitor. In embodiments, inhibition refers to reduction of a disease or symptoms of disease. In embodiments, inhibition refers to a reduction in the activity of a particular protein target. Thus, inhibition includes, at least in part, partially or totally blocking stimulation, decreasing, preventing, or delaying activation, or inactivating, desensitizing, or down-regulating signal transduction or enzymatic activity or the amount of a protein. In embodiments, inhibition refers to a reduction of activity of a target protein resulting from a direct interaction (e.g. an inhibitor binds to the target protein). In embodiments, inhibition refers to a reduction of activity of a target protein from an indirect interaction (e.g. an inhibitor binds to a protein that activates the target protein, thereby preventing target protein activation).

The terms "inhibitor," "repressor" or "antagonist" or "downregulator" interchangeably refer to a substance capable of detectably decreasing the expression or activity of a given gene or protein. The antagonist can decrease expression or activity 10%, 20%, 30%, 40%, 50%, 60%, 70%, 80%, 90% or more in comparison to a control in the absence of the antagonist. In certain instances, expression or activity is 1.5-fold, 2-fold, 3-fold, 4-fold, 5-fold, 10-fold or lower than the expression or activity in the absence of the antagonist.

The term "expression" includes any step involved in the production of the polypeptide including, but not limited to, transcription, post-transcriptional modification, translation, post-translational modification, and secretion. Expression can be detected using conventional techniques for detecting protein (e.g., ELISA, Western blotting, flow cytometry, immunofluorescence, immunohistochemistry, etc.).

An "effective amount" is an amount sufficient for a compound to accomplish a stated purpose relative to the absence of the compound (e.g. achieve the effect for which it is administered, treat a disease, reduce enzyme activity, increase enzyme activity, reduce a signaling pathway, or reduce one or more symptoms of a disease or condition). An "activity decreasing amount," as used herein, refers to an amount of antagonist required to decrease the activity of an enzyme relative to the absence of the antagonist. A "function disrupting amount," as used herein, refers to the amount of antagonist required to disrupt the function of an enzyme or protein relative to the absence of the antagonist.

A "cell" as used herein, refers to a cell carrying out metabolic or other function sufficient to preserve or replicate its genomic DNA. A cell can be identified by well-known methods in the art including, for example, presence of an intact membrane, staining by a particular dye, ability to produce progeny or, in the case of a gamete, ability to combine with a second gamete to produce a viable offspring. Cells may include prokaryotic and eukaryotic cells. Prokaryotic cells include but are not limited to bacteria. Eukaryotic cells include but are not limited to yeast cells and cells derived from plants and animals, for example mammalian, insect (e.g., *spodoptera*) and human cells.

"Control" or "control experiment" is used in accordance with its plain ordinary meaning and refers to an experiment in which the subjects or reagents of the experiment are treated as in a parallel experiment except for omission of a procedure, reagent, or variable of the experiment. In some instances, the control is used as a standard of comparison in evaluating experimental effects. In some embodiments, a control is the measurement of the activity of a protein in the absence of a compound as described herein (including embodiments and examples).

The term "modulate" is used in accordance with its plain ordinary meaning and refers to the act of changing or varying one or more properties. "Modulation" refers to the process of changing or varying one or more properties.

The term "kit" is used in accordance with its plain ordinary meaning and refers to any delivery system for delivering materials or reagents for carrying out a method of the invention. Such delivery systems include systems that allow for the storage, transport, or delivery of reaction reagents (e.g., nucleotides, enzymes, nucleic acid templates, etc. in the appropriate containers) and/or supporting materials (e.g., buffers, written instructions for performing the reaction, etc.) from one location to another location. For example, kits include one or more enclosures (e.g., boxes) containing the relevant reaction reagents and/or supporting materials. Such contents may be delivered to the intended recipient together or separately. For example, a first container may contain an enzyme, while a second container contains nucleotides. In embodiments, the kit includes vessels containing one or more enzymes, primers, adaptors, or other reagents as described herein. Vessels may include any structure capable of supporting or containing a liquid or solid material and may include, tubes, vials, jars, containers, tips, etc. In embodiments, a wall of a vessel may permit the transmission of light through the wall. In embodiments, the vessel may be optically clear. The kit may include the enzyme and/or nucleotides in a buffer. In embodiments, the buffer includes an acetate buffer, 3-(N-morpholino)propanesulfonic acid (MOPS) buffer, N-(2-Acetamido)-2-aminoethanesulfonic acid (ACES) buffer, phosphate-buffered saline (PBS) buffer, 4-(2-hydroxyethyl)-1-piperazineethanesulfonic acid (HEPES) buffer, N-(1,1-Dimethyl-2-hydroxyethyl)-3-amino-2-hydroxypropanesulfonic acid (AMPSO) buffer, borate buffer (e.g., borate buffered saline, sodium borate buffer, boric acid buffer), 2-Amino-2-methyl-1,3-propanediol (AMPD) buffer, N-cyclohexyl-2-hydroxyl-3-aminopropanesulfonic acid (CAPSO) buffer, 2-Amino-2-methyl-1-propanol (AMP) buffer, 4-(Cyclohexylamino)-1-butanesulfonic acid (CABS) buffer, glycine-NaOH buffer, N-Cyclohexyl-2-aminoethanesulfonic acid (CHES) buffer, tris(hydroxymethyl)aminomethane (Tris) buffer, or a N-cyclohexyl-3-aminopropanesulfonic acid (CAPS) buffer. In embodiments, the buffer is a borate buffer. In embodiments, the buffer is a CHES buffer.

Where a range of values is provided, it is understood that each intervening value, to the tenth of the unit of the lower limit unless the context clearly indicates otherwise, between the upper and lower limit of that range, and any other stated or unstated intervening value in, or smaller range of values within, that stated range is encompassed within the invention. The upper and lower limits of any such smaller range (within a more broadly recited range) may independently be included in the smaller ranges, or as particular values themselves, and are also encompassed within the invention, subject to any specifically excluded limit in the stated range. Where the stated range includes one or both of the limits, ranges excluding either or both of those included limits are also included in the invention.

A "patentable" process, machine, or article of manufacture according to the invention means that the subject matter satisfies all statutory requirements for patentability at the time the analysis is performed. For example, with regard to novelty, non-obviousness, or the like, if later investigation reveals that one or more claims encompass one or more embodiments that would negate novelty, non-obviousness, etc., the claim(s), being limited by definition to "patentable" embodiments, specifically exclude the unpatentable embodiment(s). In addition, the claims appended hereto are to be interpreted both to provide the broadest reasonable scope, as well as to preserve their validity. Furthermore, if one or more of the statutory requirements for patentability are amended or if the standards change for assessing whether a particular statutory requirement for patentability is satisfied from the time this application is filed or issues as a patent to a time the validity of one or more of the appended claims is questioned, the claims are to be interpreted in a way that (1) preserves their validity and (2) provides the broadest reasonable interpretation under the circumstances.

The phrase "stringent hybridization conditions" refers to conditions under which a primer will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, *Techniques in Biochemistry and Molecular Biology—Hybridization with Nucleic Probes*, "Overview of principles of hybridization and the strategy of nucleic acid assays" (1993). Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C.

II. Polymerases

Provided herein are, inter alia, are modified Archaea Family B DNA polymerases. Archaeal DNA polymerases are Family B polymerases that characteristically have separate domains for DNA polymerase activity and 3'-5' exonuclease activity. The exonuclease domain is characterized by as many as six and at least three conserved amino acid sequence motifs in and around a structural binding pocket. Examples of archaeal polymerases include polymerases obtained from species of *Thermococcus*, *Pyrococcus* and *Sulfolobus*. During polymerization, nucleotides are added to the 3' end of the primer strand and during the 3'-5' exonuclease reaction, the 3' terminus of the primer is shifted to the 3'-5' exonuclease domain and the one or more of the 3'-terminal nucleotides are hydrolyzed.

In embodiments, the variants of a *Pyrococcus abyssi* family B DNA polymerase provided herein have no detectable exonuclease activity and are useful in methods of incorporating modified nucleotides in nucleic acid synthesis reactions. In embodiments, the polymerase is a thermophilic nucleic acid polymerase.

Parent archaeal polymerases may be DNA polymerases that are isolated from naturally occurring organisms. The parent DNA polymerases, also referred to as wild type polymerase, share the property of having a structural binding pocket that binds and hydrolyzes a substrate nucleic acid, producing 5'-dNMP. The structural binding pocket in this family of polymerases also shares the property of having sequence motifs that form the binding pocket, referred to as Exo Motifs I-VI. In embodiments, the parent or wild type *P. abyssi* polymerase has an amino acid sequence comprising SEQ ID NO: 1. In embodiments, the variant *P. abyssi* polymerase from which further variants are produced has an amino acid sequence comprising SEQ ID NO: 3.

"Synthetic" DNA polymerases refer to non-naturally occurring DNA polymerases such as those constructed by synthetic methods, mutated parent DNA polymerases such as truncated DNA polymerases and fusion DNA polymerases (e.g. U.S. Pat. No. 7,541,170). Variants of the parent DNA polymerase have been engineered by mutating residues using site-directed or random mutagenesis methods known in the art. In embodiments, the mutations are in any of Motifs I-VI. The variant is expressed in an expression system such as *E. coli* by methods known in the art. The variant is then screened using the assays described herein to determine exonuclease activity.

In embodiments, the polymerase (a synthetic or variant DNA polymerase) provided herein may contain 1, 2, 3, 4, 5, 6, 7, 8, 9, 10, 11, 12 or more mutations as compared to the wild-type sequence of *P. abyssi* family B DNA polymerase of SEQ ID NO: 1. The polymerase (a synthetic or variant DNA polymerase) may contain 10, 20, 30, 40, 50 or more mutations as compared to the wild-type sequence of *P. abyssi* family B DNA polymerase of SEQ ID NO: 1. The polymerase (a synthetic or variant DNA polymerase) may contain between 10 and 20, between 20 and 30, between 30 and 40, or between 40 or 50 mutations as compared to the wild-type sequence of *P. abyssi* family B DNA polymerase of SEQ ID NO: 1.

In an aspect, the polymerase (a synthetic or variant DNA polymerase) provided herein may have one or more amino acid substitution mutations between positions 129 and 316 inclusive of endpoint positions. In embodiments, the polymerase (a synthetic or variant DNA polymerase) provided herein may have one or more amino acid substitution mutations at position 129, 141, 142, 143, 144, 209, 210, 213, 214, 215, 274, 275, 311 and/or 315.

In an aspect is provided a polymerase including an amino acid sequence that is at least 80% identical to a continuous 500 amino acid sequence within SEQ ID NO: 1. In embodiments, the polymerase includes an amino acid sequence that is at least 85% identical to a continuous 500 amino acid sequence within SEQ ID NO: 1. In embodiments, the polymerase includes an amino acid sequence that is at least 90% identical to a continuous 500 amino acid sequence within SEQ ID NO: 1. In embodiments, the polymerase includes an amino acid sequence that is at least 95% identical to a continuous 500 amino acid sequence within SEQ ID NO: 1.

In an aspect is provided a polymerase including an amino acid sequence that is at least 80% identical to a continuous 500 amino acid sequence within SEQ ID NO: 1. In embodiments, the polymerase includes the following amino acids: an alanine, serine, or histidine, at amino acid position 409 or any amino acid that is functionally equivalent to the amino acid position 409; a glycine or alanine at amino acid position 410 or any amino acid that is functionally equivalent to the amino acid position 410; and a proline, valine, or isoleucine at amino acid position 411 or any amino acid that is functionally equivalent to the amino acid position 411. In embodiments, the polymerase includes the following amino acids: an alanine, serine, glutamine, or histidine, at amino acid position 409 or any amino acid that is functionally equivalent to the amino acid position 409; a glycine or alanine at amino acid position 410 or any amino acid that is functionally equivalent to the amino acid position 410; and a proline, valine, serine, glycine, alanine, threonine, leucine, or isoleucine at amino acid position 411 or any amino acid that is functionally equivalent to the amino acid position 411. In embodiments, the polymerase includes an alanine at amino acid position 409 or any amino acid that is functionally equivalent to the amino acid position 409. In embodiments, the polymerase includes a serine at amino acid position 409 or any amino acid that is functionally equivalent to the amino acid position 409. In embodiments, the polymerase includes a glutamine at amino acid position 409 or any amino acid that is functionally equivalent to the amino acid position 409. In embodiments, the polymerase includes a histidine at amino acid position 409 or any amino acid that is functionally equivalent to the amino acid position 409. In embodiments, the polymerase includes a glycine at amino acid position 410 or any amino acid that is functionally equivalent to the amino acid position 410. In embodiments, the polymerase includes an alanine at amino acid position 410 or any amino acid that is functionally equivalent to the amino acid position 410. In embodiments, the polymerase includes a proline at amino acid position 411 or any amino acid that is functionally equivalent to the amino acid position 411. In embodiments, the polymerase includes a valine at amino acid position 411 or any amino acid that is functionally equivalent to the amino acid position 411. In embodiments, the polymerase includes a serine at amino acid position 411 or any amino acid that is functionally equivalent to the amino acid position 411. In embodiments, the polymerase includes a glycine at amino acid position 411 or any amino acid that is functionally equivalent to the amino acid position 411. In embodiments, the polymerase includes a, alanine at amino acid position 411 or any amino acid that is functionally equivalent to the amino acid position 411. In embodiments, the polymerase includes a threonine at amino acid position 411 or any amino acid that is functionally equivalent to the amino acid position 411. In embodiments, the polymerase includes a leucine at amino acid position 411 or any amino acid that is functionally equivalent to the amino acid position 411. In embodiments, the polymerase includes an isoleucine at amino acid position 411 or any amino acid that is functionally equivalent to the amino acid position 411.

In an aspect is provided a polymerase including an amino acid sequence that is at least 95% identical to a continuous 500 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 96% identical to a continuous 500 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 97% identical to a continuous 500 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 98% identical to a continuous 500 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 99% identical to a continuous 500 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 95% identical to a continuous 600 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 96% identical to a continuous 600 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 97% identical to a continuous 600 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 98% identical to a continuous 600 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 99% identical to a continuous 600 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 95% identical to a continuous 700 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 96% identical to a continuous 700 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 97% identical to a continuous 700 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 98% identical to a continuous 700 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 99% identical to a continuous 700 amino acid sequence within SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 95% identical to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO:

145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 96% identical to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 97% identical to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 98% identical to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In an aspect is provided a polymerase including an amino acid sequence that is at least 99% identical to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, or SEQ ID NO: 203.

In embodiments, the polymerase includes a serine, histidine, or alanine at amino acid position 409 or any amino acid that is functionally equivalent to the amino acid position 409. In embodiments, the polymerase includes an alanine or glycine at amino acid position 410 or any amino acid that is functionally equivalent to the amino acid position 410. In embodiments, the polymerase includes a valine, isoleucine, or proline at amino acid position 411 or any amino acid that is functionally equivalent to the amino acid position 411. In embodiments, the polymerase includes a serine at amino acid position 409 or any amino acid that is functionally equivalent to the amino acid position 409. In embodiments, the polymerase includes a histidine at amino acid position 409 or any amino acid that is functionally equivalent to the amino acid position 409. In embodiments, the polymerase includes an alanine at amino acid position 409 or any amino acid that is functionally equivalent to the amino acid position 409. In embodiments, the polymerase includes an alanine at amino acid position 410 or any amino acid that is functionally equivalent to the amino acid position 410. In embodiments, the polymerase includes a glycine at amino acid position 410 or any amino acid that is functionally equivalent to the amino acid position 410. In embodiments, the polymerase includes a valine at amino acid position 411 or any amino acid that is functionally equivalent to the amino acid position 411. In embodiments, the polymerase includes an isoleucine at amino acid position 411 or any amino acid that is functionally equivalent to the amino acid position 411. In embodiments, the polymerase includes a proline at amino acid position 411 or any amino acid that is functionally equivalent to the amino acid position 411.

In embodiments, the polymerase includes an alanine at amino acid position 409; an alanine or glycine at amino acid position 410; and an isoleucine, or proline at amino acid position 411. In embodiments, the polymerase includes an alanine at amino acid position 409; an alanine at amino acid position 410; and an isoleucine, or proline at amino acid position 411. In embodiments, the polymerase includes an alanine at amino acid position 409; an alanine at amino acid position 410; and an isoleucine at amino acid position 411. In embodiments, the polymerase includes an alanine at amino acid position 409; an alanine or glycine at amino acid position 410; and proline at amino acid position 411. In embodiments, the polymerase includes an alanine at amino acid position 409; a glycine at amino acid position 410; and an isoleucine, or proline at amino acid position 411. In embodiments, the polymerase includes an alanine at amino acid position 409; a glycine at amino acid position 410; and an isoleucine at amino acid position 411. In embodiments, the amino acids at positions 409, 410 and 411 (or any amino acid that is functionally equivalent to the amino acid position 409, 410, and 411 are alanine, glycine, and proline, respectively. In embodiments, the amino acids at positions 409, 410 and 411 (or any amino acid that is functionally equivalent to the amino acid position 409, 410, and 411 are alanine, glycine, and valine, respectively. In embodiments, the amino acids at positions 409, 410 and 411 (or any amino acid that is functionally equivalent to the amino acid position 409, 410, and 411 are alanine, glycine, and isoleucine, respectively. In embodiments, the amino acids at positions 409, 410 and 411 (or any amino acid that is functionally equivalent to the amino acid position 409, 410, and 411 are alanine, alanine, and proline, respectively. In embodiments, the amino acids at positions 409, 410 and 411 (or any amino acid that is functionally equivalent to the amino acid position 409, 410, and 411 are alanine, alanine, and valine, respectively. In embodiments, the amino acids at positions 409, 410 and 411 (or any amino acid that is functionally equivalent to the amino acid position 409, 410, and 411 are alanine, alanine, and isoleucine, respectively. In embodiments, the amino acids at positions 409, 410 and 411 (or any amino acid that is functionally equivalent to the amino acid position 409, 410, and 411 are serine, glycine, and proline, respectively. In embodiments, the amino acids at positions 409, 410 and 411 (or any amino acid that is functionally equivalent to the amino acid position 409, 410, and 411 are serine, glycine, and valine, respectively. In embodiments, the amino acids at positions 409, 410 and 411 (or any amino acid that is functionally equivalent to the amino acid position 409, 410, and 411 are serine, glycine, and isoleucine, respectively. In embodiments, the amino acids at positions 409, 410 and 411 (or any amino acid that is functionally equivalent to the amino acid position 409, 410, and 411 are serine, alanine, and proline, respectively. In embodiments, the amino acids at positions 409, 410 and 411 (or any amino acid that is functionally equivalent to the amino acid position 409, 410, and 411 are serine, alanine, and valine, respectively. In embodiments, the amino acids at positions 409, 410 and 411 (or any amino acid that is functionally equivalent to the amino acid position 409, 410, and 411 are serine, alanine, and isoleucine, respectively. In embodiments, the amino acids at positions 409, 410 and 411 (or any amino acid that is functionally equivalent to the amino acid position 409, 410, and 411 are histidine, glycine, and proline, respectively. In embodiments, the amino acids at positions 409, 410 and 411 (or any amino acid that is functionally equivalent to the amino acid position 409, 410, and 411 are histidine, glycine, and valine, respectively. In embodiments, the amino acids at positions 409, 410 and 411 (or any amino acid that is functionally equivalent to the amino acid position 409, 410, and 411 are histidine, glycine, and isoleucine, respectively. In embodiments, the amino acids at positions 409, 410 and 411 (or any amino acid that is functionally equivalent to the amino acid position 409, 410, and 411 are histidine, alanine, and proline, respectively. In embodiments, the amino acids at positions 409, 410 and 411 (or any amino acid that is functionally equivalent to the amino acid position 409, 410, and 411 are histidine, alanine, and valine, respectively. In embodiments, the amino acids at positions 409, 410 and 411 (or any amino acid that is functionally equivalent to the amino acid position 409, 410, and 411 are histidine, alanine, and isoleucine, respectively.

In embodiments, the polymerase includes an alanine at amino acid position 409; a glycine at amino acid position 410; and an isoleucine or proline at amino acid position 411.

In embodiments, the polymerase includes a serine at amino acid position 409; an alanine or glycine at amino acid position 410; and a valine, isoleucine, or proline at amino acid position 411.

In embodiments, the polymerase includes a serine at amino acid position 409; an alanine at amino acid position 410; and a valine, isoleucine, or proline at amino acid position 411.

In embodiments, the polymerase includes an amino acid substitution mutation between position 129 and 316 of SEQ ID NO: 1, inclusive of position endpoints.

In embodiments, the polymerase further includes an amino acid substitution mutation at positions 129, 141, and 143. In embodiments, the polymerase further includes an amino acid substitution mutation at positions 129, 141, or 143.

In embodiments, the polymerase further includes an amino acid substitution mutation at position 129. In embodiments, the polymerase further includes an alanine amino acid substitution mutation at position 129.

In embodiments, the polymerase further includes an amino acid substitution mutation at position 141. In embodiments, the polymerase further includes an alanine amino acid substitution mutation at position 141.

In embodiments, the polymerase further includes an amino acid substitution mutation at position 143. In embodiments, the polymerase further includes an alanine amino acid substitution mutation at position 143.

In embodiments, the polymerase further includes an amino acid substitution mutation at position 144. In embodiments, the polymerase further includes an alanine amino acid substitution mutation at position 144.

In embodiments, the polymerase further includes an amino acid substitution mutation at position 486. In embodiments, the polymerase includes a leucine or valine substitution mutation at position 486. In embodiments, the polymerase includes a leucine substitution mutation at position 486. In embodiments, the polymerase includes a valine substitution mutation at position 486.

In embodiments, the polymerase further includes an amino acid substitution mutation at position 515. In embodiments, the polymerase includes a serine at position 515.

In embodiments, the polymerase further includes an amino acid substitution mutation at position 590. In embodiments, the polymerase includes an isoleucine at position 590.

In embodiments, the polymerase includes the following mutations: M129A, D141A, T144A, E143A, L409A, Y410G, A486V, T515S, and T590I. In embodiments, the polymerase includes the following mutations: M129A, D141A, T144A, E143A, L409A, Y410G, P411I, A486V, T515S, and G153E. In embodiments, the polymerase includes the following mutations: M129A, D141A, T144A, E143A, L409A, Y410G, P411I, A486V, T515S, and K712E. In embodiments, the polymerase includes the following mutations: M129A, D141A, E143A, L409A, Y410G, P411I, A486V, T515S, I522L, and G153E. In embodiments, the polymerase includes the following mutations: M129A, D141A, E143A, L409A, Y410G, P411, and A486V. In embodiments, the polymerase includes the following mutations: M129A, D141A, E143A, L409A, Y410G, P411I, A486V, T515S, and T590I. In embodiments, the polymerase includes the following mutations: M129A, D141A, E143A, T144A, D215A, D315A, L409A, Y410A, P411I, A486V, and T515S. In embodiments, the polymerase includes the following mutations: M129A, D141A, T144A, E143A, L409A, Y410G, P411I, A486V, T515S, and T590I. In embodiments, the polymerase includes the following mutations: M129A, D141A, T144A, E143A, L409A, Y410G, P411I, A486V, T515S, and K477W. In embodiments, the polymerase includes the following mutations: M129A, D141A, E143A, L409A, Y410G, P411I, A486V, T515S, I522L, and K712E. In embodiments, the polymerase includes the following mutations: M129A, D141A, E143A, T144A, L409A, Y410G, P411I, A486V, T515S, T590I, and R705A. In embodiments, the polymerase includes the following mutations: M129A, D141A, E143A, T144A, L409A, Y410G, P411I, A486V, and T515S. In embodiments, the polymerase includes the following mutations: M129A, D141A, E143A, T144A, L409A, Y410G, P411I, A486V, T515S, T590I, and E718N. In embodiments, the polymerase includes the following mutations: M129A, D141A, E143A, T144A, L409A, Y410G, P411I, A486V, T515S, T590I, and A639L. In embodiments, the polymerase includes the following mutations: M129A, D141A, E143A, L409A, Y410G, P411I, T515A, and A486V. In embodiments, the polymerase includes the following mutations: M129A, D141A, E143A, T144A, L409A, Y410G, P411I, A486V, T515S, T590I, and E718A. In embodiments, the polymerase includes the following mutations: M129A, D141A, T144A, E143A, L409A, Y410G, P411I, A486V, I522L, and G153E. In embodiments, the polymerase includes the following mutations: M129A, D141A, T144A, E143A, L409A, Y410G, P411I, A486V, T515S, and K478M. In embodiments, the polymerase includes the following mutations: M129A, D141A, E143A, T144A, L409A, Y410G, P411I, A486V, T515S, T590I, and R713A. In embodiments, the polymerase includes the following mutations: M129A, D141A, E143A, L409A, Y410A, P411I, A486V, and T515S. In embodiments, the polymerase includes the following mutations: M129A, D141A, E143A, L409S, Y410G, P411I, and A486V. In embodiments, the polymerase includes the following mutations: M129A, D141A, E143A, L409A, Y410G, P411I, A486V, and T515S. In embodiments, the polymerase includes the following mutations: M129A, D141A, E143A, L409A, Y410A, P411I, A486V, and T590I. In embodiments, the polymerase includes the following mutations: M129A, D141A, E143A, L409S, Y410G, P411S, and A486V. In embodiments, the polymerase includes the following mutations: M129A, D141A, E143A, T144A, L409A, Y410G, P411I, A486V, T515S, T590I, and A639V. In embodiments, the polymerase includes the following mutations: M129A, D141A, E143A, L409A, Y410G, P411V, and A486V. In embodiments, the polymerase includes the following mutations: M129A, D141A, E143A, L409A, Y410G, P411I, T590S, and A486V. In embodiments, the polymerase includes the following mutations: M129A, D141A, E143A, T144A, L409A, Y410G, P411I, A486V, T515S, T590I, and L479S. In embodiments, the polymerase includes the following mutations: M129A, D141A, E143A, T144A, L409A, Y410G, P411I, A486V, and T590I. In embodiments, the polymerase includes the following mutations: M129A, D141A, E143A, D215A, D315A, L409A, Y410A, P411I, A486V, T515S, and T590I. In embodiments, the polymerase includes the following mutations: M129A, D141A, E143A, T144A, D215A, D315A, L409A, Y410A, P411I, A486V, and T590I. In embodiments, the polymerase includes the following mutations: M129A, D141A, E143A, L409A, Y410G, P411I, and A486L. In embodiments, the polymerase includes the following mutations: M129A, D141A, E143A, T144A, L409A, Y410A, P411I, and A486V. In embodiments, the polymerase includes the following mutations: M129A, D141A, E143A, L409A, Y410G, P411G, and A486V. In embodiments, the polymerase includes the following mutations: M129A, D141A, E143A, D315A, L409A, Y410G, P411I, and A486V. In embodiments, the polymerase includes the following mutations: M129A, D141A, D143A, L409A, Y410G, P411I, A486V, and A639V. In embodiments, the polymerase includes the following mutations: M129A, D141A, E143A, L409Q, Y410A, P411I, and A486V. In embodiments, the polymerase includes the following mutations: M129A, D141A, E143A, D215A, L409A, Y410G, P411I, and A486V. In embodiments, the polymerase includes the following mutations: M129A, D141A, E143A, L409A, Y410G, P411I, A486V, and T590I. In embodiments, the polymerase includes the following mutations: M129A, D141A, E143A, T144A, L409A, Y410G, P411I, A486V, T515S, T590I, and L479A. In embodiments, the polymerase includes the following mutations: M129A, D141A, E143A, T144A, L409A, Y410G, P411I, A486V, T515S, T590I, and L479A. In embodiments, the polymerase includes the following mutations: M129A, D141A, E143A, T144A, L409A, Y410G, P411I, and A486V. In embodiments, the polymerase includes the following mutations: M129A, D141A, E143A, L409A, Y410A, P411I, A486V, and D215A. In embodiments, the polymerase includes the following mutations: M129A, D141A, E143A, L409A, Y410G, P411A, and A486V. In embodiments, the polymerase includes the following mutations: M129A, D141A, E143A, L409A, Y410A, P411I, A486V, and D315A. In embodiments, the polymerase includes the following mutations: M129A, D141A, E143A, D215A, D315A, L409A, Y410G, P411I, and A486V. In embodiments, the polymerase includes the following mutations: M129A, D141A, E143A, L409A, Y410G, P411T, and A486V. In embodiments, the polymerase includes the following mutations: M129A, D141A, E143A, L409A, Y410A, P411I, A486V, D215A, and D315A.

In embodiments, the polymerase includes the following mutations: M129A, D141A, E143A, L409A, Y410G, P411, and A486V. In embodiments, the polymerase includes the following mutations: M129A, D141A, E143A, L409A, Y410G, P411V, and A486V. In embodiments, the polymerase includes the following mutations: M129A, D141A, E143A, L409A, Y410G, P411L, and A486V. In embodiments, the polymerase includes the following mutations: M129A, D141A, E143A, L409S, Y410G, P411I, and A486V. In embodiments, the polymerase includes the following mutations: M129A, D141A, E143A, L409H, Y410G, P411I, and A486V. In embodiments, the polymerase includes the following mutations: M129A, D141A, E143A, L409A, Y410G, P411G, and A486V. In embodiments, the polymerase includes the following mutations: M129A, D141A, E143A, L409A, Y410A, P411I, A486V, and T515S. In embodiments, the polymerase includes the following mutations: M129A, D141A, E143A, L409A, Y410G, P411S, and A486V. In embodiments, the polymerase includes the following mutations: M129A, D141A, E143A, L409A, Y410G, P411I, A486V, and T515S. In embodiments, the polymerase includes the following mutations: M129A, D141A, E143A, L409A, Y410G, P411T, and A486V. In embodiments, the polymerase includes the following mutations: M129A, D141A, D143A, L409A, Y410G, P411I, A486V, and T590I. In embodiments, the polymerase includes the following mutations: M129A, D141A, E143A, L409G, Y410G, P411I, and A486V. In embodiments, the polymerase includes the following mutations: M129A, D141A, E143A, L409A, Y410G, P411I, A486V, T515S, and T590I. In embodiments, the polymerase includes the following mutations: M129A, D141A, E143A, L409A, Y410G, P411I, and A486L. In embodiments, the polymerase is a polymerase described herein (e.g., described in a claim, figure, or sequence listing). In embodiments, the polymerase is a polymerase having the sequence described in SEQ ID NO: 1. In embodiments, the polymerase is a polymerase having the sequence described in SEQ ID NO: 2. In embodiments, the polymerase is a polymerase having the sequence described in SEQ ID NO: 3. In embodiments, the polymerase is a polymerase having the sequence described in SEQ ID NO: 4. In embodiments, the polymerase is a polymerase having the sequence described in SEQ ID NO: 5. In embodiments, the polymerase is a polymerase having the sequence described in SEQ ID NO: 6. In embodiments, the polymerase is a polymerase having the sequence described in SEQ ID NO: 7. In embodiments, the polymerase is a polymerase having the sequence described in SEQ ID NO: 8. In embodiments, the polymerase is a polymerase having the sequence described in SEQ ID NO: 9. In embodiments, the polymerase is a polymerase having the sequence described in SEQ ID NO: 10. In embodiments, the polymerase is a polymerase having the sequence described in SEQ ID NO: 11. In embodiments, the polymerase is a polymerase having the sequence described in SEQ ID NO: 12. In embodiments, the polymerase is a polymerase having the sequence described in SEQ ID NO: 13. In embodiments, the polymerase is a polymerase having the sequence described in SEQ ID NO: 14. In embodiments, the polymerase is a polymerase having the sequence described in SEQ ID NO: 15. In embodiments, the polymerase is a polymerase having the sequence described in SEQ ID NO: 16. In embodiments, the polymerase is a polymerase having the sequence described in SEQ ID NO: 17. In embodiments, the polymerase is a polymerase having the sequence described in SEQ ID NO: 18. In embodiments, the polymerase is a polymerase having the sequence described in SEQ ID NO: 19. In embodiments, the polymerase is a polymerase having the sequence described in SEQ ID NO: 20. In embodiments, the polymerase is a polymerase having the sequence described in SEQ ID NO: 21. In embodiments, the polymerase is a polymerase having the sequence described in SEQ ID NO: 22. In embodiments, the polymerase is a polymerase having the sequence described in SEQ ID NO: 23. In embodiments, the polymerase is a polymerase having the sequence described in SEQ ID NO: 24. In embodiments, the polymerase is a polymerase having the sequence described in SEQ ID NO: 25. In embodiments, the polymerase is a polymerase having the sequence described in SEQ ID NO: 26. In embodiments, the polymerase is a polymerase having the sequence described in SEQ ID NO: 27. In embodiments, the polymerase is a polymerase having the sequence described in SEQ ID NO: 28. In embodiments, the polymerase is a polymerase having the sequence described in SEQ ID NO: 29. In embodiments, the polymerase is a polymerase having the sequence described in SEQ ID NO: 30. In embodiments, the polymerase is a polymerase having the sequence described in SEQ ID NO: 31. In embodiments, the polymerase is a polymerase having the sequence described in SEQ ID NO: 32. In embodiments, the polymerase is a polymerase having the sequence described in SEQ ID NO: 33. In embodiments, the polymerase is a polymerase having the sequence described in SEQ ID NO: 34. In embodiments, the polymerase is a polymerase having the sequence described in SEQ ID NO: 35. In embodiments, the polymerase is a polymerase having the sequence described in SEQ ID NO: 36. In embodiments, the polymerase is a polymerase having the sequence described in SEQ ID NO: 37. In embodiments, the polymerase is a polymerase having the sequence described in SEQ ID NO: 38. In embodiments, the polymerase is a polymerase having the sequence described in SEQ ID NO: 39. In embodiments, the polymerase is a polymerase having the sequence described in SEQ ID NO: 40. In embodiments, the polymerase is a polymerase having the sequence described in SEQ ID NO: 41. In embodiments, the polymerase is a polymerase having the sequence described in SEQ ID NO: 42. In embodiments, the polymerase is a polymerase having the sequence described in SEQ ID NO: 43. In embodiments, the polymerase is a polymerase having the sequence described in SEQ ID NO: 44. In embodiments, the polymerase is a polymerase having the sequence described in SEQ ID NO: 45. In embodiments, the polymerase is a polymerase having the sequence described in SEQ ID NO: 46. In embodiments, the polymerase is a polymerase having the sequence described in SEQ ID NO: 47. In embodiments, the polymerase is a polymerase having the sequence described in SEQ ID NO: 48. In embodiments, the polymerase is a polymerase having the sequence described in SEQ ID NO: 49. In embodiments, the polymerase is a polymerase having the sequence described in SEQ ID NO: 50. In embodiments, the polymerase is a polymerase having the sequence described in SEQ ID NO: 51. In embodiments, the polymerase is a polymerase having the sequence described in SEQ ID NO: 52. In embodiments, the polymerase is a polymerase having the sequence described in SEQ ID NO: 53. In embodiments, the polymerase is a polymerase having the sequence described in SEQ ID NO: 54. In embodiments, the polymerase is a polymerase having the sequence described in SEQ ID NO: 55. In embodiments, the polymerase is a polymerase having the sequence described in SEQ ID NO: 56. In embodiments, the polymerase is a polymerase having the sequence described in SEQ ID NO: 57. In embodiments, the polymerase is a polymerase having the sequence described in SEQ ID NO: 58. In embodiments, the polymerase is a polymerase having the sequence described in SEQ ID NO: 59. In embodiments, the polymerase is a polymerase having the sequence described in SEQ ID NO: 60. In embodiments, the polymerase is a polymerase having the sequence described in SEQ ID NO: 61. In embodiments, the polymerase is a polymerase having the sequence described in SEQ ID NO: 62. In embodiments, the polymerase is a polymerase having the sequence described in SEQ ID NO: 63. In embodiments, the polymerase is a polymerase having the sequence described in SEQ ID NO: 64. In embodiments, the polymerase is a polymerase having the sequence described in SEQ ID NO: 65. In embodiments, the polymerase is a polymerase having the sequence described in SEQ ID NO: 66. In embodiments, the polymerase is a polymerase having the sequence described in SEQ ID NO: 67. In embodiments, the polymerase is a polymerase having the sequence described in SEQ ID NO: 68. In embodiments, the polymerase is a polymerase having the sequence described in SEQ ID NO: 69. In embodiments, the polymerase is a polymerase having the sequence described in SEQ ID NO: 70. In embodiments, the polymerase is a polymerase having the sequence described in SEQ ID NO: 71. In embodiments, the polymerase is a polymerase having the sequence described in SEQ ID NO: 72. In embodiments, the polymerase is a polymerase having the sequence described in SEQ ID NO: 73. In embodiments, the polymerase is a polymerase having the sequence described in SEQ ID NO: 74. In embodiments, the polymerase is a polymerase having the sequence described in SEQ ID NO: 75. In embodiments, the polymerase is a polymerase having the sequence described in SEQ ID NO: 76. In embodiments, the polymerase is a polymerase having the sequence described in SEQ ID NO: 77. In embodiments, the polymerase is a polymerase having the sequence described in SEQ ID NO: 78. In embodiments, the polymerase is a polymerase having the sequence described in SEQ ID NO: 79. In embodiments, the polymerase is a polymerase having the sequence described in SEQ ID NO: 80. In embodiments, the polymerase is a polymerase having the sequence described in SEQ ID NO: 81. In embodiments, the polymerase is a polymerase having the sequence described in SEQ ID NO: 82. In embodiments, the polymerase is a polymerase having the sequence described in SEQ ID NO: 83. In embodiments, the polymerase is a polymerase having the sequence described in SEQ ID NO: 84. In embodiments, the polymerase is a polymerase having the sequence described in SEQ ID NO: 85. In embodiments, the polymerase is a polymerase having the sequence described in SEQ ID NO: 86. In embodiments, the polymerase is a polymerase having the sequence described in SEQ ID NO: 87. In embodiments, the polymerase is a polymerase having the sequence described in SEQ ID NO: 88. In embodiments, the polymerase is a polymerase having the sequence described in SEQ ID NO: 89. In embodiments, the polymerase is a polymerase having the sequence described in SEQ ID NO: 90. In embodiments, the polymerase is a polymerase having the sequence described in SEQ ID NO: 91. In embodiments, the polymerase is a polymerase having the sequence described in SEQ ID NO: 92. In embodiments, the polymerase is a polymerase having the sequence described in SEQ ID NO: 93. In embodiments, the polymerase is a polymerase having the sequence described in SEQ ID NO: 94. In embodiments, the polymerase is a polymerase having the sequence described in SEQ ID NO: 95. In embodiments, the polymerase is a polymerase having the sequence described in SEQ ID NO: 96. In embodiments, the polymerase is a polymerase having the sequence described in SEQ ID NO: 97. In embodiments, the polymerase is a polymerase having the sequence described in SEQ ID NO: 98. In embodiments, the polymerase is a polymerase having the sequence described in SEQ ID NO: 99. In embodiments, the polymerase is a polymerase having the sequence described in SEQ ID NO: 100. In embodiments, the polymerase is a polymerase having the sequence described in SEQ ID NO: 101. In embodiments, the polymerase is a polymerase having the sequence described in SEQ ID NO: 102. In embodiments, the polymerase is a polymerase having the sequence described in SEQ ID NO: 103. In embodiments, the polymerase is a polymerase having the sequence described in SEQ ID NO: 104. In embodiments, the polymerase is a polymerase having the sequence described in SEQ ID NO: 105. In embodiments, the polymerase is a polymerase having the sequence described in SEQ ID NO: 106. In embodiments, the polymerase is a polymerase having the sequence described in SEQ ID NO: 107. In embodiments, the polymerase is a polymerase having the sequence described in SEQ ID NO: 108. In embodiments, the polymerase is a polymerase having the sequence described in SEQ ID NO: 109. In embodiments, the polymerase is a polymerase having the sequence described in SEQ ID NO: 110. In embodiments, the polymerase is a polymerase having the sequence described in SEQ ID NO: 111. In embodiments, the polymerase is a polymerase having the sequence described in SEQ ID NO: 112. In embodiments, the polymerase is a polymerase having the sequence described in SEQ ID NO: 113. In embodiments, the polymerase is a polymerase having the sequence described in SEQ ID NO: 114. In embodiments, the polymerase is a polymerase having the sequence described in SEQ ID NO: 115. In embodiments, the polymerase is a polymerase having the sequence described in SEQ ID NO: 116. In embodiments, the polymerase is a polymerase having the sequence described in SEQ ID NO: 117. In embodiments, the polymerase is a polymerase having the sequence described in SEQ ID NO: 118. In embodiments, the polymerase is a polymerase having the sequence described in SEQ ID NO: 119. In embodiments, the polymerase is a polymerase having the sequence described in SEQ ID NO: 120. In embodiments, the polymerase is a polymerase having the sequence described in SEQ ID NO: 121. In embodiments, the polymerase is a polymerase having the sequence described in SEQ ID NO: 122. In embodiments, the polymerase is a polymerase having the sequence described in SEQ ID NO: 123. In embodiments, the polymerase is a polymerase having the sequence described in SEQ ID NO: 124. In embodiments, the polymerase is a polymerase having the sequence described in SEQ ID NO: 125. In embodiments, the polymerase is a polymerase having the sequence described in SEQ ID NO: 126. In embodiments, the polymerase is a polymerase having the sequence described in SEQ ID NO: 127. In embodiments, the polymerase is a polymerase having the sequence described in SEQ ID NO: 128. In embodiments, the polymerase is a polymerase having the sequence described in SEQ ID NO: 129. In embodiments, the polymerase is a polymerase having the sequence described in SEQ ID NO: 130. In embodiments, the polymerase is a polymerase having the sequence described in SEQ ID NO: 131. In embodiments, the polymerase is a polymerase having the sequence described in SEQ ID NO: 132. In embodiments, the polymerase is a polymerase having the sequence described in SEQ ID NO: 133. In embodiments, the polymerase is a polymerase having the sequence described in SEQ ID NO: 134. In embodiments, the polymerase is a polymerase having the sequence described in SEQ ID NO: 135. In embodiments, the polymerase is a polymerase having the sequence described in SEQ ID NO: 136. In embodiments, the polymerase is a polymerase having the sequence described in SEQ ID NO: 137. In embodiments, the polymerase is a polymerase having the sequence described in SEQ ID NO: 138. In embodiments, the polymerase is a polymerase having the sequence described in SEQ ID NO: 139. In embodiments, the polymerase is a polymerase having the sequence described in SEQ ID NO: 140. In embodiments, the polymerase is a polymerase having the sequence described in SEQ ID NO: 141. In embodiments, the polymerase is a polymerase having the sequence described in SEQ ID NO: 142. In embodiments, the polymerase is a polymerase having the sequence described in SEQ ID NO: 143. In embodiments, the polymerase is a polymerase having the sequence described in SEQ ID NO: 144. In embodiments, the polymerase is a polymerase having the sequence described in SEQ ID NO: 145. In embodiments, the polymerase is a polymerase having the sequence described in SEQ ID NO: 146. In embodiments, the polymerase is a polymerase having the sequence described in SEQ ID NO: 147. In embodiments, the polymerase is a polymerase having the sequence described in SEQ ID NO: 148. In embodiments, the polymerase is a polymerase having the sequence described in SEQ ID NO: 149. In embodiments, the polymerase is a polymerase having the sequence described in SEQ ID NO: 150. In embodiments, the polymerase is a polymerase having the sequence described in SEQ ID NO: 151. In embodiments, the polymerase is a polymerase having the sequence described in SEQ ID NO: 152. In embodiments, the polymerase is a polymerase having the sequence described in SEQ ID NO: 153. In embodiments, the polymerase is a polymerase having the sequence described in SEQ ID NO: 154. In embodiments, the polymerase is a polymerase having the sequence described in SEQ ID NO: 155. In embodiments, the polymerase is a polymerase having the sequence described in SEQ ID NO: 156. In embodiments, the polymerase is a polymerase having the sequence described in SEQ ID NO: 157. In embodiments, the polymerase is a polymerase having the sequence described in SEQ ID NO: 158. In embodiments, the polymerase is a polymerase having the sequence described in SEQ ID NO: 159. In embodiments, the polymerase is a polymerase having the sequence described in SEQ ID NO: 160. In embodiments, the polymerase is a polymerase having the sequence described in SEQ ID NO: 161. In embodiments, the polymerase is a polymerase having the sequence described in SEQ ID NO: 162. In embodiments, the polymerase is a polymerase having the sequence described in SEQ ID NO: 163. In embodiments, the polymerase is a polymerase having the sequence described in SEQ ID NO: 164. In embodiments, the polymerase is a polymerase having the sequence described in SEQ ID NO: 165. In embodiments, the polymerase is a polymerase having the sequence described in SEQ ID NO: 166. In embodiments, the polymerase is a polymerase having the sequence described in SEQ ID NO: 167. In embodiments, the polymerase is a polymerase having the sequence described in SEQ ID NO: 168. In embodiments, the polymerase is a polymerase having the sequence described in SEQ ID NO: 169. In embodiments, the polymerase is a polymerase having the sequence described in SEQ ID NO: 170. In embodiments, the polymerase is a polymerase having the sequence described in SEQ ID NO: 171. In embodiments, the polymerase is a polymerase having the sequence described in SEQ ID NO: 172. In embodiments, the polymerase is a polymerase having the sequence described in SEQ ID NO: 173. In embodiments, the polymerase is a polymerase having the sequence described in SEQ ID NO: 174. In embodiments, the polymerase is a polymerase having the sequence described in SEQ ID NO: 175. In embodiments, the polymerase is a polymerase having the sequence described in SEQ ID NO: 176. In embodiments, the polymerase is a polymerase having the sequence described in SEQ ID NO: 177. In embodiments, the polymerase is a polymerase having the sequence described in SEQ ID NO: 178. In embodiments, the polymerase is a polymerase having the sequence described in SEQ ID NO: 179. In embodiments, the polymerase is a polymerase having the sequence described in SEQ ID NO: 180. In embodiments, the polymerase is a polymerase having the sequence described in SEQ ID NO: 181. In embodiments, the polymerase is a polymerase having the sequence described in SEQ ID NO: 182. In embodiments, the polymerase is a polymerase having the sequence described in SEQ ID NO: 183. In embodiments, the polymerase is a polymerase having the sequence described in SEQ ID NO: 184. In embodiments, the polymerase is a polymerase having the sequence described in SEQ ID NO: 185. In embodiments, the polymerase is a polymerase having the sequence described in SEQ ID NO: 186. In embodiments, the polymerase is a polymerase having the sequence described in SEQ ID NO: 187. In embodiments, the polymerase is a polymerase having the sequence described in SEQ ID NO: 188. In embodiments, the polymerase is a polymerase having the sequence described in SEQ ID NO: 189. In embodiments, the polymerase is a polymerase having the sequence described in SEQ ID NO: 190. In embodiments, the polymerase is a polymerase having the sequence described in SEQ ID NO: 191. In embodiments, the polymerase is a polymerase having the sequence described in SEQ ID NO: 192. In embodiments, the polymerase is a polymerase having the sequence described in SEQ ID NO: 193. In embodiments, the polymerase is a polymerase having the sequence described in SEQ ID NO: 194. In embodiments, the polymerase is a polymerase having the sequence described in SEQ ID NO: 195. In embodiments, the polymerase is a polymerase having the sequence described in SEQ ID NO: 196. In embodiments, the polymerase is a polymerase having the sequence described in SEQ ID NO: 197. In embodiments, the polymerase is a polymerase having the sequence described in SEQ ID NO: 198. In embodiments, the polymerase is a polymerase having the sequence described in SEQ ID NO: 199. In embodiments, the polymerase is a polymerase having the sequence described in SEQ ID NO: 200. In embodiments, the polymerase is a polymerase having the sequence described in SEQ ID NO: 201. In embodiments, the polymerase is a polymerase having the sequence described in SEQ ID NO: 202. In embodiments, the polymerase is a polymerase having the sequence described in SEQ ID NO: 203.

In embodiments, the polymerase exhibits an increased rate of incorporation of modified nucleotides, relative to a control (e.g., wild-type *P. abyssi* DNA polymerase or SG1200). In embodiments, the rate of incorporation is increased 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, or 6.0-fold relative to a control (e.g., wild-type *P. abyssi* or SG1200). In embodiments, the rate of incorporation is increased 1-fold, 2-fold, 3-fold, 4-fold, 5-fold, or 6.0-fold relative to a control (e.g., wild-type *P. abyssi* or SG1200). In embodiments, the rate of incorporation of a modified nucleotide is increased 1.1-fold relative to a control (e.g., wild-type *P. abyssi* or SG1200). In embodiments, the rate of incorporation of a modified nucleotide is increased 1.2-fold relative to a control (e.g., wild-type *P. abyssi* or SG1200). In embodiments, the rate of incorporation of a modified nucleotide is increased 1.3-fold relative to a control (e.g., wild-type *P. abyssi* or SG1200). In embodiments, the rate of incorporation of a modified nucleotide is increased 1.4-fold relative to a control (e.g., wild-type *P. abyssi* or SG1200). In embodiments, the rate of incorporation of a modified nucleotide is increased 1.5-fold relative to a control (e.g., wild-type *P. abyssi* or SG1200). In embodiments, the rate of incorporation of a modified nucleotide is increased 1.6-fold relative to a control (e.g., wild-type *P. abyssi* or SG1200). In embodiments, the rate of incorporation of a modified nucleotide is increased 1.7-fold relative to a control (e.g., wild-type *P. abyssi* or SG1200). In embodiments, the rate of incorporation of a modified nucleotide is increased 1.8-fold relative to a control (e.g., wild-type *P. abyssi* or SG1200). In embodiments, the rate of incorporation of a modified nucleotide is increased 1.9-fold relative to a control (e.g., wild-type *P. abyssi* or SG1200). In embodiments, the rate of incorporation of a modified nucleotide is increased 2.0-fold relative to a control (e.g., wild-type *P. abyssi* or SG1200). In embodiments, the rate of incorporation of a modified nucleotide is increased 2.1-fold relative to a control (e.g., wild-type *P. abyssi* or SG1200). In embodiments, the rate of incorporation of a modified nucleotide is increased 2.2-fold relative to a control (e.g., wild-type *P. abyssi* or SG1200). In embodiments, the rate of incorporation of a modified nucleotide is increased 2.3-fold relative to a control (e.g., wild-type *P. abyssi* or SG1200). In embodiments, the rate of incorporation of a modified nucleotide is increased 2.4-fold relative to a control (e.g., wild-type *P. abyssi* or SG1200). In embodiments, the rate of incorporation of a modified nucleotide is increased 2.5-fold relative to a control (e.g., wild-type *P. abyssi* or SG1200). In embodiments, the rate of incorporation of a modified nucleotide is increased 2.6-fold relative to a control (e.g., wild-type *P. abyssi* or SG1200). In embodiments, the rate of incorporation of a modified nucleotide is increased 2.7-fold relative to a control (e.g., wild-type *P. abyssi* or SG1200). In embodiments, the rate of incorporation of a modified nucleotide is increased 2.8-fold relative to a control (e.g., wild-type *P. abyssi* or SG1200). In embodiments, the rate of incorporation of a modified nucleotide is increased 2.9-fold relative to a control (e.g., wild-type *P. abyssi* or SG1200). In embodiments, the rate of incorporation of a modified nucleotide is increased 3.0-fold relative to a control (e.g., wild-type *P. abyssi* or SG1200). In embodiments, the rate of incorporation of a modified nucleotide is increased 3.1-fold relative to a control (e.g., wild-type *P. abyssi* or SG1200). In embodiments, the rate of incorporation of a modified nucleotide is increased 3.2-fold relative to a control (e.g., wild-type *P. abyssi* or SG1200). In embodiments, the rate of incorporation of a modified nucleotide is increased 3.3-fold relative to a control (e.g., wild-type *P. abyssi* or SG1200). In embodiments, the rate of incorporation of a modified nucleotide is increased 3.4-fold relative to a control (e.g., wild-type *P. abyssi* or SG1200). In embodiments, the rate of incorporation of a modified nucleotide is increased 3.5-fold relative to a control (e.g., wild-type *P. abyssi* or SG1200). In embodiments, the rate of incorporation of a modified nucleotide is increased 3.6-fold relative to a control (e.g., wild-type *P. abyssi* or SG1200). In embodiments, the rate of incorporation of a modified nucleotide is increased 3.7-fold relative to a control (e.g., wild-type *P. abyssi* or SG1200). In embodiments, the rate of incorporation of a modified nucleotide is increased 3.8-fold relative to a control (e.g., wild-type *P. abyssi* or SG1200). In embodiments, the rate of incorporation of a modified nucleotide is increased 3.9-fold relative to a control (e.g., wild-type *P. abyssi* or SG1200). In embodiments, the rate of incorporation of a modified nucleotide is increased 4.0-fold relative to a control (e.g., wild-type *P. abyssi* or SG1200). In embodiments, the rate of incorporation of a modified nucleotide is increased 4.1-fold relative to a control (e.g., wild-type *P. abyssi* or SG1200). In embodiments, the rate of incorporation of a modified nucleotide is increased 4.2-fold relative to a control (e.g., wild-type *P. abyssi* or SG1200). In embodiments, the rate of incorporation of a modified nucleotide is increased 4.3-fold relative to a control (e.g., wild-type *P. abyssi* or SG1200). In embodiments, the rate of incorporation of a modified nucleotide is increased 4.4-fold relative to a control (e.g., wild-type *P. abyssi* or SG1200). In embodiments, the rate of incorporation of a modified nucleotide is increased 4.5-fold relative to a control (e.g., wild-type *P. abyssi* or SG1200). In embodiments, the rate of incorporation of a modified nucleotide is increased 4.6-fold relative to a control (e.g., wild-type *P. abyssi* or SG1200). In embodiments, the rate of incorporation of a modified nucleotide is increased 4.7-fold relative to a control (e.g., wild-type *P. abyssi* or SG1200). In embodiments, the rate of incorporation of a modified nucleotide is increased 4.8-fold relative to a control (e.g., wild-type *P. abyssi* or SG1200). In embodiments, the rate of incorporation of a modified nucleotide is increased 4.9-fold relative to a control (e.g., wild-type *P. abyssi* or SG1200). In embodiments, the rate of incorporation of a modified nucleotide is increased 5.0-fold relative to a control (e.g., wild-type *P. abyssi* or SG1200). In embodiments, the rate of incorporation of a modified nucleotide is increased 5.1-fold relative to a control (e.g., wild-type *P. abyssi* or SG1200). In embodiments, the rate of incorporation of a modified nucleotide is increased 5.2-fold relative to a control (e.g., wild-type *P. abyssi* or SG1200). In embodiments, the rate of incorporation of a modified nucleotide is increased 5.3-fold relative to a control (e.g., wild-type *P. abyssi* or SG1200). In embodiments, the rate of incorporation of a modified nucleotide is increased 5.4-fold relative to a control (e.g., wild-type *P. abyssi* or SG1200). In embodiments, the rate of incorporation of a modified nucleotide is increased 5.5-fold relative to a control (e.g., wild-type *P. abyssi* or SG1200). In embodiments, the rate of incorporation of a modified nucleotide is increased 5.6-fold relative to a control (e.g., wild-type *P. abyssi* or SG1200). In embodiments, the rate of incorporation of a modified nucleotide is increased 5.7-fold relative to a control (e.g., wild-type *P. abyssi* or SG1200). In embodiments, the rate of incorporation of a modified nucleotide is increased 5.8-fold relative to a control (e.g., wild-type *P. abyssi* or SG1200). In embodiments, the rate of incorporation of a modified nucleotide is increased 5.9-fold relative to a control (e.g., wild-type *P. abyssi* or SG1200). In embodiments, the rate of incorporation of a modified nucleotide is increased 6.0-fold relative to a control (e.g., wild-type *P. abyssi* or SG1200). In embodiments, the rate of incorporation of a modified nucleotide is increased 6.1-fold relative to a control (e.g., wild-type *P. abyssi* or SG1200). In embodiments, the rate of incorporation of a modified nucleotide is increased 6.2-fold relative to a control (e.g., wild-type *P. abyssi* or SG1200). In embodiments, the rate of incorporation of a modified nucleotide is increased 6.3-fold relative to a control (e.g., wild-type *P. abyssi* or SG1200). In embodiments, the rate of incorporation of a modified nucleotide is increased 6.4-fold relative to a control (e.g., wild-type *P. abyssi* or SG1200). In embodiments, the rate of incorporation of a modified nucleotide is increased 6.5-fold relative to a control (e.g., wild-type *P. abyssi* or SG1200). In embodiments, the rate of incorporation of a modified nucleotide is increased 6.6-fold relative to a control (e.g., wild-type *P. abyssi* or SG1200). In embodiments, the rate of incorporation of a modified nucleotide is increased 6.7-fold relative to a control (e.g., wild-type *P. abyssi* or SG1200). In embodiments, the rate of incorporation of a modified nucleotide is increased 6.8-fold relative to a control (e.g., wild-type *P. abyssi* or SG1200). In embodiments, the rate of incorporation of a modified nucleotide is increased 6.9-fold relative to a control (e.g., wild-type *P. abyssi* or SG1200). In embodiments, the rate of incorporation of a modified nucleotide is increased about 2-fold relative to a control (e.g., wild-type *P. abyssi* or SG1200). In embodiments, the rate of incorporation of a modified nucleotide is increased about 3-fold relative to a control (e.g., wild-type *P. abyssi* or SG1200). In embodiments, the rate of incorporation of a modified nucleotide is increased about 4-fold relative to a control (e.g., wild-type *P. abyssi* or SG1200). In embodiments, the rate of incorporation of a modified nucleotide is increased about 5-fold relative to a control (e.g., wild-type *P. abyssi* or SG1200). In embodiments, the rate of incorporation of a modified nucleotide is increased about 6-fold relative to a control (e.g., wild-type *P. abyssi* or SG1200). In embodiments, the rate of incorporation of a modified nucleotide is increased about 7-fold relative to a control (e.g., wild-type *P. abyssi* or SG1200). In embodiments, the rate of incorporation of a modified nucleotide is increased about 8-fold relative to a control (e.g., wild-type *P. abyssi* or SG1200). In embodiments, the rate of incorporation of a modified nucleotide is increased about 9-fold relative to a control (e.g., wild-type *P. abyssi* or SG1200). In embodiments, the rate of incorporation of a modified nucleotide is increased about 10-fold relative to a control (e.g., wild-type *P. abyssi* or SG1200). In embodiments, the rate of incorporation of a modified nucleotide is increased 2-fold relative to a control (e.g., wild-type *P. abyssi* or SG1200). In embodiments, the rate of incorporation of a modified nucleotide is increased 3-fold relative to a control (e.g., wild-type *P. abyssi* or SG1200). In embodiments, the rate of incorporation of a modified nucleotide is increased 4-fold relative to a control (e.g., wild-type *P. abyssi* or SG1200). In embodiments, the rate of incorporation of a modified nucleotide is increased 5-fold relative to a control (e.g., wild-type *P. abyssi* or SG1200). In embodiments, the rate of incorporation of a modified nucleotide is increased 6-fold relative to a control (e.g., wild-type *P. abyssi* or SG1200). In embodiments, the rate of incorporation of a modified nucleotide is increased 7-fold relative to a control (e.g., wild-type *P. abyssi* or SG1200). In embodiments, the rate of incorporation of a modified nucleotide is increased 8-fold relative to a control (e.g., wild-type *P. abyssi* or SG1200). In embodiments, the rate of incorporation of a modified nucleotide is increased 9-fold relative to a control (e.g., wild-type *P. abyssi* or SG1200). In embodiments, the rate of incorporation of a modified nucleotide is increased 10-fold relative to a control (e.g., wild-type *P. abyssi* or SG1200).

In embodiments, the polymerase includes the mutation A486L. In embodiments, the polymerase includes the mutation A639L. In embodiments, the polymerase includes the mutation D215A. In embodiments, the polymerase includes the mutation D315A. In embodiments, the polymerase includes the mutation E718A. In embodiments, the polymerase includes the mutation G153E. In embodiments, the polymerase includes the mutation I522L. In embodiments, the polymerase includes the mutation K477A. In embodiments, the polymerase includes the mutation K477A, K478A, and L479S. In embodiments, the polymerase includes the mutation K478A. In embodiments, the polymerase includes the mutation K602A. In embodiments, the polymerase includes the mutation K712E. In embodiments, the polymerase includes the mutation L479S. In embodiments, the polymerase includes the mutation N735A. In embodiments, the polymerase includes the mutation R705A. In embodiments, the polymerase includes the mutation R713A.

In embodiments, the polymerase includes an amino acid substitution at position 129. The amino acid substitution at position 129 may be an alanine substitution, a glycine substitution, a valine substitution, a leucine substitution or an isoleucine substitution. In embodiments, the amino acid substitution at position 129 is an alanine substitution.

In embodiments, the polymerase includes an amino acid substitution at position 141. The amino acid substitution at position 141 may be an alanine substitution, a glycine substitution, a methionine substitution, a valine substitution, a leucine substitution or an isoleucine substitution. In embodiments, the amino acid substitution at position 141 is an alanine substitution.

In embodiments, the polymerase includes an amino acid substitution at position 143. The amino acid substitution at position 143 may be an alanine substitution, a glycine substitution, a methionine substitution, a valine substitution, a leucine substitution or an isoleucine substitution. In embodiments, the amino acid substitution at position 143 is an alanine substitution.

In embodiments, the polymerase includes an amino acid substitution at position 142. The amino acid substitution at position 142 may be an alanine substitution, a glycine substitution, a methionine substitution, a valine substitution, or a leucine substitution. In embodiments, the amino acid substitution at position 142 is a glycine substitution. In embodiments, the polymerase includes an amino acid substitution at position 144. The amino acid substitution at position 144 may be a lysine substitution or an arginine substitution. In embodiments, the amino acid substitution at position 144 is an arginine substitution. In embodiments, the polymerase includes an amino acid substitution at 209. The amino acid substitution at position 209 may be an alanine substitution, a glycine substitution, a methionine substitution, a valine substitution, a leucine substitution, or an isoleucine substitution. In embodiments, the amino acid substitution at position 209 is a glycine substitution. In embodiments, the polymerase includes an amino acid substitution at position 210. The amino acid substitution at position 210 may be an alanine substitution, a glycine substitution, a methionine substitution, a valine substitution, a leucine substitution, or an isoleucine substitution. In embodiments, the amino acid substitution at position 210 is a glycine substitution. In embodiments, the polymerase includes an amino acid substitution at position 213. The amino acid substitution at position 213 may be an alanine substitution, a glycine substitution, a methionine substitution, a valine substitution, a leucine substitution, or an isoleucine substitution. In embodiments, the amino acid substitution at position 213 is a glycine substitution. In embodiments, the polymerase includes an amino acid substitution at position 214. The amino acid substitution at position 214 may be an alanine substitution, a glycine substitution, a methionine substitution, a valine substitution, a leucine substitution, or an isoleucine substitution. In embodiments, the amino acid substitution at position 214 is a glycine substitution. In embodiments, the polymerase includes an amino acid substitution at position 215. The amino acid substitution at position 215 may be an alanine substitution, a glycine substitution, a methionine substitution, a valine substitution, a leucine substitution, or an isoleucine substitution. In embodiments, the amino acid substitution at position 215 is an alanine substitution. In embodiments, the polymerase includes an amino acid substitution at position 274. The amino acid substitution at position 274 may be lysine substitution or an arginine substitution. In embodiments, the amino acid substitution at position 274 is an arginine substitution. In embodiments, the polymerase includes an amino acid substitution at position 275. The amino acid substitution at position 275 may be an aspartic acid substitution or a glutamic acid substitution. In embodiments, the amino acid substitution at position 275 is glutamic acid. In embodiments, the polymerase includes an amino acid substitution at position 311. The amino acid substitution at position 311 may be an alanine substitution, a glycine substitution, a methionine substitution, a valine substitution, a leucine substitution, or an isoleucine substitution. In embodiments, the amino acid substitution at position 311 is a glycine substitution. In embodiments, the polymerase includes an amino acid substitution at position 315. The amino acid substitution at position 315 may be an alanine substitution, a glycine substitution, a methionine substitution, a valine substitution, a leucine substitution, or an isoleucine substitution. In embodiments, the amino acid substitution at position 315 is an alanine substitution.

In embodiments, the polymerase (a synthetic or variant DNA polymerase) provided herein may further include one or more amino acid substitution mutations between position 317 and 771, inclusive of endpoint positions. In embodiments, the polymerase (a synthetic or variant DNA polymerase) provided herein may have one or more amino acid substitution mutations at position 405, 408, 409, 410, 411, 461, 484, 486, 488, 492, 495, 496, 497, 540, 542, and/or 543.

In embodiments, the polymerase includes an amino acid substitution at position 409. The amino acid substitution at position 409 may be a serine substitution, a threonine substitution, an asparagine substation, or a glutamine substitution. In embodiments, the amino acid substitution at position 409 is a serine substitution. In embodiments, the amino acid substitution at position 409 may be an alanine substitution, a glycine substitution, a valine substitution, a methionine substitution, a leucine substitution or an isoleucine substitution. In embodiments, the amino acid substitution at position 409 is an alanine substitution.

In embodiments, the polymerase includes an amino acid substitution at position 410. The amino acid substitution at position 410 may be an alanine substitution, a glycine substitution, a valine substitution, a methionine substitution, a leucine substitution or an isoleucine substitution. In embodiments, the amino acid substitution at position 410 is an alanine substitution.

In embodiments, the polymerase includes an amino acid substitution at position 411. The amino acid substitution at position 411 may be an alanine substitution, a glycine substitution, a valine substitution, a methionine substitution, a leucine substitution or an isoleucine substitution. In embodiments, the amino acid substitution at position 411 is a valine substitution or an isoleucine substitution. In embodiments, the amino acid substitution at position 411 is a valine substitution. In embodiments, the amino acid substitution at position 411 is an isoleucine substitution.

In embodiments, the polymerase includes an amino acid substitution at position 486. The amino acid substitution at position 486 may be a glycine substitution, methionine substitution, a valine substitution, a leucine substitution or an isoleucine substitution. In embodiments, the amino acid substitution at position 486 is a valine substitution.

In embodiments, the polymerase includes an amino acid substitution at position 405, 408, 461, 484, 488, 492, 495, 496, 497, 540, 542, and/or 543. In embodiments, the polymerase includes an amino acid substitution at position 405. The amino acid substitution at position 405 may be aspartic acid. In embodiments, the polymerase includes an amino acid substitution at position 408. The amino acid substitution at position 408 may be an alanine substitution, glycine substitution, methionine substitution, a valine substitution, a leucine substitution or an isoleucine substitution. In embodiments, the amino acid substitution at position 408 is an alanine substitution. In embodiments, the polymerase includes an amino acid substitution at position 484. The amino acid substitution at position 484 may be a serine substitution, a threonine substitution, or an asparagine substitution. In embodiments, the amino acid substitution at position 484 is an asparagine substitution. In embodiments, the polymerase includes an amino acid substitution at position 488. The amino acid substitution at position 488 may be an arginine substitution or a lysine substitution. In embodiments, the amino acid substitution at position 488 is an arginine substitution. In embodiments, the polymerase includes an amino acid substitution at position 492. The amino acid substitution at position 492 may be a serine substitution, a threonine substitution, or a glutamine substitution. In embodiments, the amino acid substitution at position 492 is a glutamine substitution. In embodiments, the polymerase includes an amino acid substitution at position 495. The amino acid substitution at position 495 may be phenylalanine substitution, a tryptophan substitution, or a histidine substitution. In embodiments, the substitution at position 495 is a phenylalanine substitution. In embodiments, the polymerase includes an amino acid substitution at position 496. In embodiments, the amino acid substitution at position 496 may be an alanine substitution, a methionine substitution, a valine substitution, a leucine substitution or an isoleucine substitution. In embodiments, the amino acid substitution at position 496 is an alanine substitution. In embodiments, the polymerase includes an amino acid substitution at position 497. The amino acid substitution at position 497 may be phenylalanine substitution, a tryptophan substitution, or a histidine substitution. In embodiments, the substitution at position 497 is a phenylalanine substitution. In embodiments, the polymerase includes an amino acid substitution at position 540. The amino acid substitution at position 540 may be a glutamic acid substitution. In embodiments, the polymerase includes an amino acid substitution at position 542. The amino acid substitution at position 542 may be a glutamic acid substitution. In embodiments, the polymerase includes an amino acid substitution at position 543. The amino acid substitution at position 543 may be an alanine substitution, methionine substitution, a valine substitution, a leucine substitution or an isoleucine substitution. In embodiments, the amino acid substitution at position 543 is an alanine substitution.

In an aspect, the polymerase (a synthetic or variant DNA polymerase) provided herein may have one or more amino acid substitution mutations at position 129, 141, 143, 409, 410, 411, and/or 486.

In embodiments, the polymerase includes an amino acid sequence that is at least 80% identical to a continuous 500 amino acid sequence within SEQ ID NO: 1. The polymerase includes substitution mutations at positions 141 and 143 of SEQ ID NO: 1. The polymerase further includes at least one amino acid substitution mutation at a position selected from positions 129, 409, 410, 411 and/or 486 of SEQ ID NO: 1.

In embodiments, the polymerase includes an amino acid sequence that is at least 85%, at least 90%, or at least 95% identical to a continuous 500 amino acid sequence within SEQ ID NO: 1. In embodiments, the polymerase includes an amino acid sequence that is at least 80%, at least 85%, at least 90%, or at least 95% identical to a continuous 600 amino acid sequence within SEQ ID NO: 1. In embodiments, the polymerase includes an amino acid sequence that is at least 80%, at least 85%, at least 90%, or at least 95% identical to a continuous 700 amino acid sequence within SEQ ID NO: 1. In embodiments, the polymerase includes an amino acid sequence that is at least 85% identical to a continuous 500 amino acid sequence within SEQ ID NO: 1. In embodiments, the polymerase includes an amino acid sequence that is at least 90% identical to a continuous 500 amino acid sequence within SEQ ID NO: 1. In embodiments, the polymerase includes an amino acid sequence that is at least 95% identical to a continuous 500 amino acid sequence within SEQ ID NO: 1. In embodiments, the polymerase includes an amino acid sequence that is at least 85% identical to a continuous 600 amino acid sequence within SEQ ID NO: 1. In embodiments, the polymerase includes an amino acid sequence that is at least 90% identical to a continuous 600 amino acid sequence within SEQ ID NO: 1. In embodiments, the polymerase includes an amino acid sequence that is at least 95% identical to a continuous 600 amino acid sequence within SEQ ID NO: 1. In embodiments, the polymerase includes an amino acid sequence that is at least 85% identical to a continuous 700 amino acid sequence within SEQ ID NO: 1. In embodiments, the polymerase includes an amino acid sequence that is at least 90% identical to a continuous 700 amino acid sequence within SEQ ID NO: 1. In embodiments, the polymerase includes an amino acid sequence that is at least 95% identical to a continuous 700 amino acid sequence within SEQ ID NO: 1.

In embodiments, the polymerase includes alanine substitution mutations at positions 141 and 143 of SEQ ID NO: 1. In embodiments, the polymerase further includes at least one amino acid substitution mutation at a position selected from positions 129, 409, 410, 411 and/or 486 of SEQ ID NO: 1. In embodiments, the polymerase further includes at least one amino acid substitution at a position selected from an alanine, glycine, leucine, isoleucine, or valine at position 129, a serine, threonine, an aspargine, glutamine, an alanine, glycine, isoleucine, valine, or methionine at position 409, an alanine at position 410, a valine, isoleucine, leucine, or methionine at position 411, and a valine, isoleucine, leucine, or methionine at position 486. In embodiments, the polymerase further includes one amino acid substitution mutations selected from a serine at position 409, an alanine at position 410, a valine at position 411, and a valine at position 486. In embodiments, the polymerase further includes one amino acid substitution mutation selected from an alanine at position 129, a serine at position 409, an alanine at position 410, an isoleucine at position 411, and a valine at position 486.

In embodiments, the polymerase includes alanine substitution mutations at positions 141 and 143 of SEQ ID NO: 1 and further includes a serine at position 409, an alanine at position 410, and a valine at position 411 as exemplified by SEQ ID NO: 71. In embodiments, the polymerase includes alanine substitution mutations at positions 141 and 143, of SEQ ID NO: 1 and further includes a serine at position 409, an alanine at position 410, a valine at position 411 and a valine at position 486 as exemplified by SEQ ID NO: 72. In embodiments, the polymerase includes alanine substitution mutations at positions 141 and 143 of SEQ ID NO: 1 and further includes an alanine at position 129, an alanine at position 409, an alanine at position 410, an isoleucine at position 411 and a valine at position 486 as exemplified by SEQ ID NO: 3.

The polymerase (a synthetic or variant DNA polymerase) may have a sequence that is at least 60%, at least 65%, at least 70%, at least 75%, at least 80%, at least 85%, at least 90%, or at least 95% identical to the wild-type sequence of *P. abyssi* family B DNA polymerase of SEQ ID NO: 1. In embodiments, the polymerase (a synthetic or variant DNA polymerase) may have a sequence that is 60%, 61%, 62%, 63%, 64%, 65%, 66%, 67%, 68%, or 69% identical to the wild-type sequence of *P. abyssi* family B DNA polymerase of SEQ ID NO: 1. The polymerase (a synthetic or variant DNA polymerase) may have a sequence that is 70%, 71%, 72%, 73%, 74%, 75%, 76%, 77%, 78%, or 79% identical to the wild-type sequence of *P. abyssi* family B DNA polymerase of SEQ ID NO: 1. The polymerase (a synthetic or variant DNA polymerase) may have a sequence that is 80%, 81%, 82%, 83%, 84%, 85%, 86%, 87%, 88%, or 89% identical to the wild-type sequence of *P. abyssi* family B DNA polymerase of SEQ ID NO: 1. The polymerase (a synthetic or variant DNA polymerase) may have a sequence that is 90%, 91%, 92%, 93%, 94%, 95%, 96%, 97%, 98%, or 99% identical to the wild-type sequence of *P. abyssi* family B DNA polymerase of SEQ ID NO: 1

The polymerase (a synthetic or variant DNA polymerase) may have a sequence that is identical to a continuous 500, 600, or 700 continuous amino acids of SEQ ID NO: 1. In embodiments, the polymerase (a synthetic or variant DNA polymerase) may have a sequence that is identical to a continuous 500, 505, 510, 515, 520, 525, 530, 535, 540, 545, 550, 555, 560, 565, 570, 575, 580, 585, 590, or 595 continuous amino acids of SEQ ID NO: 1. In embodiments, the polymerase (a synthetic or variant DNA polymerase) may have a sequence that is identical to a continuous 600, 605, 610, 615, 620, 625, 630, 635, 640, 645, 650, 655, 660, 665, 670, 675, 680, 685, 690, or 695 continuous amino acids of SEQ ID NO: 1.

Examples of mutations giving rise to an exo⁻/exo⁻ variants include mutations at positions in a parent polymerase corresponding to positions in SEQ ID NO: 1 identified as follows: 129, 141 and 143.

In embodiments, mutations may include substitution of the amino acid in the parent amino acid sequences with an amino acid, which is not the parent amino acid. In embodiments, the mutations may result in conservative amino acid changes. In embodiments, non-polar amino acids may be converted into polar amino acids (threonine, asparagine, glutamine, cysteine, tyrosine, aspartic acid, glutamic acid or histidine) or the parent amino acid may be changed to an alanine.

Alternatively, mutations may be randomly generated within the various motifs (within or outside the highly conserved sequences described) using standard techniques known in the art and the resultant enzymes can be tested using the sensitive assays described in the Examples to determine whether they have substantially no exonuclease activity.

In embodiments, the polymerase does not comprise the following mutations: (L409S); (L409Q); (L409Y); or (L409F); (Y410G); (Y410A); or (Y410S); and (P411S); (P411I); (P411C); (P411A).

In embodiments, the polymerase does not include any of the mutations in the motif A region (i.e., the region corresponding to amino acid positions 409, 410, and 411 of wild type *P. abyssi*, or any amino acid that is functionally equivalent to the amino acid sequences 409, 410, and 411 of wild type *P. abyssi*) as described in the table below, Table 1, that is listed above.

TABLE 1

Motif A mutations

| | 409 | 410 | 411 |
|---|---|---|---|
| J1 | S | G | S |
| J2 | S | G | I |
| J3 | S | G | C |
| J4 | S | G | A |
| J5 | S | A | S |
| J6 | S | A | I |
| J7 | S | A | C |
| J8 | S | A | A |
| J9 | S | S | S |
| J10 | S | S | I |
| J11 | S | S | C |
| J12 | S | S | A |
| J13 | Q | G | S |
| J14 | Q | G | I |
| J15 | Q | G | C |
| J16 | Q | G | A |
| J17 | Q | A | S |
| J18 | Q | A | I |
| J19 | Q | A | C |
| J20 | Q | A | A |
| J21 | Q | S | S |
| J22 | Q | S | I |
| J23 | Q | S | C |
| J24 | Q | S | A |
| J25 | Y | G | S |
| J26 | Y | G | I |
| J27 | Y | G | C |
| J28 | Y | G | A |
| J29 | Y | A | S |
| J30 | Y | A | I |
| J31 | Y | A | C |
| J32 | Y | A | A |
| J33 | Y | S | S |
| J34 | Y | S | I |
| J35 | Y | S | C |
| J36 | Y | S | A |
| J37 | F | G | S |
| J38 | F | G | I |
| J39 | F | G | C |
| J40 | F | G | A |
| J41 | F | A | S |
| J42 | F | A | I |
| J43 | F | A | C |
| J44 | F | A | A |
| J45 | F | S | S |
| J46 | F | S | I |

TABLE 1-continued

Motif A mutations

| | 409 | 410 | 411 |
|---|---|---|---|
| J47 | F | S | C |
| J48 | F | S | A |

Functionally equivalent, positionally equivalent and homologous amino acids within the wild type amino acid sequences of two different polymerases do not necessarily have to be the same type of amino acid residue, although functionally equivalent, positionally equivalent and homologous amino acids are commonly conserved. By way of example, the motif A region of 9° N polymerase has the sequence LYP, the functionally homologous region of Vent™ polymerase also has sequence LYP. In the case of these two polymerases the homologous amino acid sequences are identical, however homologous regions in other polymerases may have different amino acid sequence.

In embodiments, the polymerase is capable of incorporating an A-Term, S-Term, or i-term (e.g., i-term1 or iterm2) reversible terminator moiety. In embodiments, the polymerase incorporates an A-Term, S-Term, or i-term (e.g., i-term1 or iterm2) reversible terminator moiety. A-Term refers to azide-containing terminators (Guo J, et al. PNAS 2008); for example having the formula:

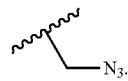

S-Term refers to sulfide-containing terminators (WO 2017/058953); for example having the formula

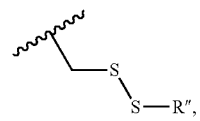

wherein R″ is unsubstituted $C_1$-$C_4$ alkyl. The i-term probe refers to an isomeric reversible terminator For example, an i-term probe has the formula:

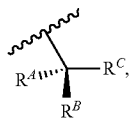

wherein $R^A$ and $R^B$ are hydrogen or alkyl, wherein at least one of $R^A$ or $R^B$ are hydrogen to yield a steroisomeric probe, and $R^C$ is the remainder of the reversible terminator.

Certain mutations in the polymerase favor the incorporation of one isomer, thus creating optimized polymerases for a unique class of reversible terminators (i.e., isomeric reversible terminators). In embodiments, the polymerase exhibits isomeric preference (i.e. it incorporates a modified nucleotide of one isomer (e.g., i-term1) at a faster rate than it incorporates a modified nucleotide of a different isomer (e.g., i-term2).

In embodiments, the nucleotide is

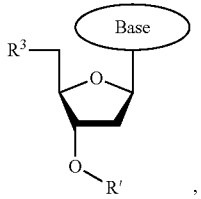

wherein Base is a Base as described herein, $R^3$ is —OH, monophosphate, or polyphosphate or a nucleic acid, and R' is a reversible terminator having the formula:

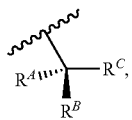

wherein $R^A$ and $R^B$ are hydrogen or alkyl and $R^C$ is the remainder of the reversible terminator. In embodiments, $R^A$ is methyl, $R^B$ is hydrogen, and $R^C$ is the remainder of the reversible terminator moiety. In embodiments, R' has the formula

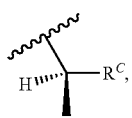

wherein $R^C$ is the remainder of the reversible terminator moiety. In embodiments, i-term1 has the formula

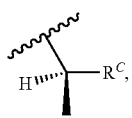

and i-term 2 has the formula:

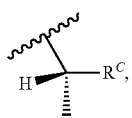

wherein $R^C$ is the remainder of the reversible terminator moiety.

In embodiments, the polymerase is SG1494, having the mutations as described in Table 7. In embodiments, the polymerase is SG1495, having the mutations as described in Table 7. In embodiments, the polymerase is SG1496, having the mutations as described in Table 7. In embodiments, the polymerase is SG1497, having the mutations as described in Table 7. In embodiments, the polymerase is SG1498, having the mutations as described in Table 7. In embodiments, the polymerase is SG1499, having the mutations as described in Table 7. In embodiments, the polymerase is SG1600, having the mutations as described in Table 7. In embodiments, the polymerase is SG1601, having the mutations as described in Table 7. In embodiments, the polymerase is SG1602, having the mutations as described in Table 7. In embodiments, the polymerase is SG1603, having the mutations as described in Table 7. In embodiments, the polymerase is SG1604, having the mutations as described in Table 7. In embodiments, the polymerase is SG1605, having the mutations as described in Table 7. In embodiments, the polymerase is SG1606, having the mutations as described in Table 7. In embodiments, the polymerase is SG1607, having the mutations as described in Table 7. In embodiments, the polymerase is SG1608, having the mutations as described in Table 7. In embodiments, the polymerase is SG1609, having the mutations as described in Table 7. In embodiments, the polymerase is SG1610, having the mutations as described in Table 7. In embodiments, the polymerase is SG1611, having the mutations as described in Table 7. In embodiments, the polymerase is SG1612, having the mutations as described in Table 7. In embodiments, the polymerase is SG1613, having the mutations as described in Table 7. In embodiments, the polymerase is SG1614, having the mutations as described in Table 7. In embodiments, the polymerase is SG1615, having the mutations as described in Table 7. In embodiments, the polymerase is SG1616, having the mutations as described in Table 7. In embodiments, the polymerase is SG1617, having the mutations as described in Table 7. In embodiments, the polymerase is SG1618, having the mutations as described in Table 7. In embodiments, the polymerase is SG1619, having the mutations as described in Table 7. In embodiments, the polymerase is SG1620, having the mutations as described in Table 7. In embodiments, the polymerase is SG1621, having the mutations as described in Table 7. In embodiments, the polymerase is SG1622, having the mutations as described in Table 7. In embodiments, the polymerase is SG1623, having the mutations as described in Table 7. In embodiments, the polymerase is SG1624, having the mutations as described in Table 7. In embodiments, the polymerase is SG1625, having the mutations as described in Table 7. In embodiments, the polymerase is SG1626, having the mutations as described in Table 7. In embodiments, the polymerase is SG1627, having the mutations as described in Table 7. In embodiments, the polymerase is SG1628, having the mutations as described in Table 7. In embodiments, the polymerase is SG1629, having the mutations as described in Table 7. In embodiments, the polymerase is SG1630, having the mutations as described in Table 7. In embodiments, the polymerase is SG1631, having the mutations as described in Table 7. In embodiments, the polymerase is SG1632, having the mutations as described in Table 7. In embodiments, the polymerase is SG1633, having the mutations as described in Table 7. In embodiments, the polymerase is SG1634, having the mutations as described in Table 7. In embodiments, the polymerase is SG1635, having the mutations as described in Table 7. In embodiments, the polymerase is SG1636, having the mutations as described in Table 7. In embodiments, the polymerase is SG1637, having the mutations as described in Table 7. In embodiments, the polymerase is SG1638, having the mutations as described in Table 7. In embodiments, the polymerase is SG1639, having the mutations as described in Table 7. In embodiments, the polymerase is SG1640, having the mutations as described in Table 7. In embodiments, the polymerase is SG1641, having the mutations as described in Table 7. In embodiments, the polymerase is SG1642, having the mutations as described in Table 7. In embodiments, the polymerase is SG1643, having the mutations as described in Table 7. In embodiments, the polymerase is SG1644, having the mutations as described in Table 7. In embodiments, the polymerase is SG1645, having the mutations as described in Table 7. In embodiments, the polymerase is SG1646, having the mutations as described in Table 7. In embodiments, the polymerase is SG1647, having the mutations as described in Table 7. In embodiments, the polymerase is SG1648, having the mutations as described in Table 7. In embodiments, the polymerase is SG1649, having the mutations as described in Table 7. In embodiments, the polymerase is SG1650, having the mutations as described in Table 7. In embodiments, the polymerase is SG1651, having the mutations as described in Table 7. In embodiments, the polymerase is SG1652, having the mutations as described in Table 7. In embodiments, the polymerase is SG1653, having the mutations as described in Table 7. In embodiments, the polymerase is SG1654, having the mutations as described in Table 7. In embodiments, the polymerase is SG1655, having the mutations as described in Table 7. In embodiments, the polymerase is SG1656, having the mutations as described in Table 7. In embodiments, the polymerase is SG1657, having the mutations as described in Table 7. In embodiments, the polymerase is SG1658, having the mutations as described in Table 7. In embodiments, the polymerase is SG1659, having the mutations as described in Table 7. In embodiments, the polymerase is SG1660, having the mutations as described in Table 7. In embodiments, the polymerase is SG1661, having the mutations as described in Table 7. In embodiments, the polymerase is SG1662, having the mutations as described in Table 7. In embodiments, the polymerase is SG1663, having the mutations as described in Table 7. In embodiments, the polymerase is SG1664, having the mutations as described in Table 7. In embodiments, the polymerase is SG1665, having the mutations as described in Table 7. In embodiments, the polymerase is SG1666, having the mutations as described in Table 7. In embodiments, the polymerase is SG1667, having the mutations as described in Table 7. In embodiments, the polymerase is SG1668, having the mutations as described in Table 7. In embodiments, the polymerase is SG1669, having the mutations as described in Table 7. In embodiments, the polymerase is SG1670, having the mutations as described in Table 7. In embodiments, the polymerase is SG1671, having the mutations as described in Table 7. In embodiments, the polymerase is SG1672, having the mutations as described in Table 7. In embodiments, the polymerase is SG1673, having the mutations as described in Table 7. In embodiments, the polymerase is SG1326, having the mutations as described in Table 7. In embodiments, the polymerase is SG1327, having the mutations as described in Table 7. In embodiments, the polymerase is SG1328, having the mutations as described in Table 7. In embodiments, the polymerase is SG1329, having the mutations as described in Table 7. In embodiments, the polymerase is SG1330, having the mutations as described in Table 7. In embodiments, the polymerase is SG1331, having the mutations as described in Table 7. In embodiments, the polymerase is SG1332, having the mutations as described in Table 7. In embodiments, the polymerase is SG1333, having the mutations as described in Table 7. In embodiments, the polymerase is SG1334, having the mutations as described in Table 7. In embodiments, the polymerase is SG1335, having the mutations as described in Table 7. In embodiments, the polymerase is SG1336, having the mutations as described in Table 7. In embodiments, the polymerase is SG1337, having the mutations as described in Table 7. In embodiments, the polymerase is SG1338, having the mutations as described in Table 7. In embodiments, the polymerase is SG1339, having the mutations as described in Table 7. In embodiments, the polymerase is SG1340, having the mutations as described in Table 7. In embodiments, the polymerase is SG1341, having the mutations as described in Table 7. In embodiments, the polymerase is SG1342, having the mutations as described in Table 7. In embodiments, the polymerase is SG1343, having the mutations as described in Table 7. In embodiments, the polymerase is SG1344, having the mutations as described in Table 7. In embodiments, the polymerase is SG1345, having the mutations as described in Table 7. In embodiments, the polymerase is SG1346, having the mutations as described in Table 7. In embodiments, the polymerase is SG1347, having the mutations as described in Table 7. In embodiments, the polymerase is SG1348, having the mutations as described in Table 7. In embodiments, the polymerase is SG1349, having the mutations as described in Table 7. In embodiments, the polymerase is SG1350, having the mutations as described in Table 7. In embodiments, the polymerase is SG1351, having the mutations as described in Table 7. In embodiments, the polymerase is SG1352, having the mutations as described in Table 7. In embodiments, the polymerase is SG1353, having the mutations as described in Table 7. In embodiments, the polymerase is SG1354, having the mutations as described in Table 7. In embodiments, the polymerase is SG1355, having the mutations as described in Table 7. In embodiments, the polymerase is SG1356, having the mutations as described in Table 7. In embodiments, the polymerase is SG1357, having the mutations as described in Table 7. In embodiments, the polymerase is SG1358, having the mutations as described in Table 7. In embodiments, the polymerase is SG1359, having the mutations as described in Table 7.

In embodiments, the polymerase (e.g., a polymerase as described herein) is truncated at the C-terminus. In embodiments, the polymerase (e.g., a polymerase as described herein) is truncated at the C-terminus and retains the ability to incorporate a modified nucleotide. In embodiments, the polymerase (e.g., a polymerase as described herein) is truncated at the C-terminus, wherein the polymerase is truncated to remove at least 20 amino acids from the C-terminus. In embodiments, the polymerase (e.g., a polymerase as described herein) is truncated at the C-terminus, wherein the polymerase is truncated to remove at least 10 amino acids from the C-terminus. In embodiments, the polymerase (e.g., a polymerase as described herein) is truncated at the C-terminus, wherein the polymerase is truncated to remove at least 5 amino acids from the C-terminus. In embodiments, the polymerase (e.g., a polymerase as described herein) is truncated at the C-terminus, wherein the truncation removes 5 to 16 amino acids from the C-terminus. In embodiments, the polymerase (e.g., a polymerase as described herein) is truncated at the C-terminus, wherein the truncation removes 5 amino acids from the C-terminus. In embodiments, the polymerase (e.g., a polymerase as described herein) is truncated at the C-terminus, wherein the truncation removes 10 amino acids from the C-terminus. In embodiments, the polymerase (e.g., a polymerase as described herein) is truncated at the C-terminus, wherein the truncation removes 13 amino acids from the C-terminus. In embodiments, the polymerase (e.g., a polymerase as described herein) is truncated at the C-terminus, wherein the truncation removes 16 amino acids from the C-terminus.

In another aspect is provided a nucleic acid encoding a mutant or improved DNA polymerase as described herein, a vector comprising the recombinant nucleic acid, and/or a host cell transformed with the vector. In certain embodiments, the vector is an expression vector. Host cells comprising such expression vectors are useful in methods of the invention for producing the mutant or improved polymerase by culturing the host cells under conditions suitable for expression of the recombinant nucleic acid. The polymerases of the invention may be contained in reaction mixtures and/or kits. The embodiments of the recombinant nucleic acids, host cells, vectors, expression vectors, reaction mixtures and kits are as described above and herein. The full plasmid nucleic acid sequence used to generate *P. abyssi* protein SG1200 is provided in SEQ ID NO: 215.

In an aspect is provided a kit. Generally, the kit includes at least one container providing a mutant or improved DNA polymerase as described herein. In embodiments, the kit further includes one or more additional containers providing one or more additional reagents. For example, the one or more additional containers provide nucleoside triphosphates; a buffer suitable for polynucleotide extension; and/or a primer hybridizable, under polynucleotide extension conditions, to a predetermined polynucleotide template. The kit may also include a template nucleic acid (DNA and/or RNA), one or more primer or probe polynucleotides, nucleoside triphosphates (including, e.g., deoxyribonucleotides, ribonucleotides, labelled nucleotides, modified nucleotides), buffers, salts, labels (e.g., fluorophores). In embodiments, the kit includes a nucleotide solution as described herein. In embodiments, the kit further includes instructions.

Methods of Use

In an aspect, a method of incorporating a modified nucleotide into a nucleic acid sequence is provided. The method includes allowing the following components to interact: (i) a nucleic acid template, (ii) a primer that has an extendible 3' end, (iii) a nucleotide solution, and (iv) a polymerase (e.g., a DNA polymerase or a thermophilic nucleic acid polymerase as described here). The polymerase used in the method includes an amino acid sequence that is at least 80% identical to a continuous 500 amino acid sequence within SEQ ID NO: 1. In embodiments, the polymerase has exonuclease activity that is reduced at least 80% relative to the exonuclease activity of a polymerase of SEQ ID NO: 1. The polymerase used in the method includes substitution mutations at positions 141 and 143 of SEQ ID NO: 1. The polymerase used in the method further includes at least one amino acid substitution mutation at a position selected from position 129, 409, 410, 411 and 486 of SEQ ID NO: 1. In embodiments, the polymerase is a polymerase as described herein (e.g., in an embodiment, claim, or SEQ ID).

In an aspect, a method of preparing a growing polynucleotide complementary to a target single-stranded polynucleotide in a sequencing reaction is provided. The method incudes incorporating a modified nucleotide molecule into a growing complementary polynucleotide, where the incorporation of the modified nucleotide prevents the introduction of any subsequent nucleotide into the growing complementary polynucleotide and wherein the incorporation of the modified nucleotide molecule is accomplished by a polymerase as described herein.

In an aspect, a method for performing a primer extension reaction is provided. The method includes contacting a modified polymerase comprising the amino acid sequence of any one of SEQ ID NO: 1-203, with a nucleic acid molecule and a modified nucleotide under conditions where the modified nucleotide is incorporated into the nucleic acid molecule by the polymerase.

In embodiments, the nucleic acid template is DNA, RNA, or analogs thereof. In embodiments, the nucleic acid template is a primer. Primers are usually single-stranded for maximum efficiency in amplification, but may alternatively be double-stranded. If double-stranded, the primer is usually first treated to separate its strands before being used to prepare extension products. This denaturation step is typically affected by heat, but may alternatively be carried out using alkali, followed by neutralization. Thus, a "primer" is complementary to a nucleic acid template, and complexes by hydrogen bonding or hybridization with the template to give a primer/template complex for initiation of synthesis by a polymerase, which is extended by the addition of covalently bonded bases linked at its 3' end complementary to the template in the process of DNA synthesis.

In embodiments, the nucleotide solution includes modified nucleotides. It is understood that a modified nucleotide and a nucleotide analogue are interchangeable terminology in this context. In embodiments, the nucleotide solution includes labelled nucleotides. In embodiments, the nucleotides include synthetic nucleotides. In embodiments, the nucleotide solution includes modified nucleotides that independently have different reversible terminating moieties (e.g., nucleotide A has an A-term reversible terminator, nucleotide G has an S-term reversible terminator, nucleotide C has an S-term reversible terminator, and nucleotide T has an i-term1 reversible terminator). In embodiments the nucleotide solution contains native nucleotides. In embodiments the nucleotide solution contains labelled nucleotides.

In embodiments, the modified nucleotide has a removable group, for example a label, a blocking group, or protecting group. The removable group includes a chemical group that can be removed from a dNTP analogue such that a DNA polymerase can extend the nucleic acid (e.g., a primer or extension product) by the incorporation of at least one additional nucleotide. In embodiments, the removal group is a reversible terminator.

In embodiments, the modified nucleotide includes a blocking moiety and/or a label moiety. The blocking moiety on a nucleotide can be reversible, whereby the blocking moiety can be removed or modified to allow the 3' hydroxyl to form a covalent bond with the 5' phosphate of another nucleotide. The blocking moiety can be effectively irreversible under particular conditions used in a method set forth herein. A label moiety of a nucleotide can be any moiety that allows the nucleotide to be detected, for example, using a spectroscopic method. In embodiments, one or more of the above moieties can be absent from a nucleotide used in the methods and compositions set forth herein. For example, a nucleotide can lack a label moiety or a blocking moiety or both.

In embodiments, the blocking moiety can be located, for example, at the 3' position of the nucleotide and may be a chemically cleavable moiety such as an allyl group, an azidomethyl group or a methoxymethyl group, or may be an enzymatically cleavable group such as a phosphate. Suitable nucleotide blocking moieties are described in applications WO 2004/018497, U.S. Pat. Nos. 7,057,026, 7,541,444, WO 96/07669, U.S. Pat. Nos. 5,763,594, 5,808,045, 5,872,244 and 6,232,465, the contents of which are incorporated herein by reference in their entirety. The nucleotides may be labelled or unlabeled. In embodiments, the modified nucleotides with reversible terminators useful in methods provided herein may be 3'-O-blocked reversible or 3'-unblocked reversible terminators. The 3'-O-blocked reversible terminators are known in the art, and may be, for instance, a 3'-ONH$_2$ reversible terminator, a 3'-O-allyl reversible terminator, or a 3'-O-azidomethyl reversible terminator.

In embodiments, the modified nucleotides useful in methods provided herein can include 3'-unblocked reversible terminators. The 3'-unblocked reversible terminators are known in the art and include for example, the "virtual terminator" as described in U.S. Pat. No. 8,114,973 and the "lightening terminator" as described in U.S. Pat. No. 10,041,115, the contents of which are incorporated herein by reference in their entirety.

In embodiments, the modified nucleotide (also referred to herein as a nucleotide analogue) has the formula:

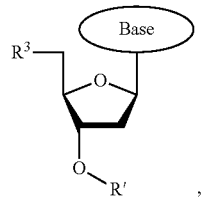

wherein Base is a Base as described herein (e.g., B of Formula Ia or Ib), $R^3$ is —OH, monophosphate, or polyphosphate or a nucleic acid, and R' is a reversible terminator having the formula:

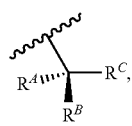

wherein $R^A$ and $R^B$ are hydrogen or alkyl and $R^C$ is the remainder of the reversible terminator. In embodiments, the reversible terminator is

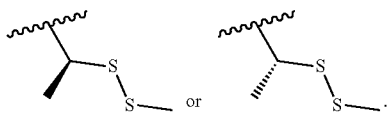

In embodiments, the reversible terminator is

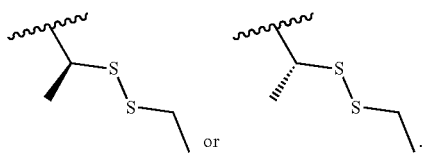

In embodiments, the reversible terminator is

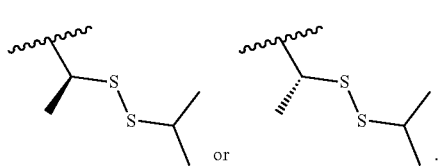

In embodiments, the reversible terminator is

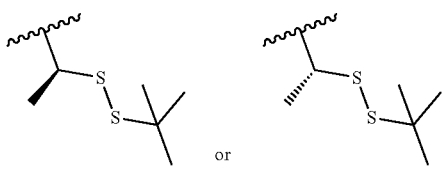

In embodiments, the reversible terminator is

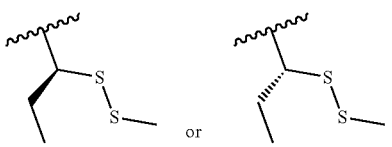

In embodiments, the reversible terminator is

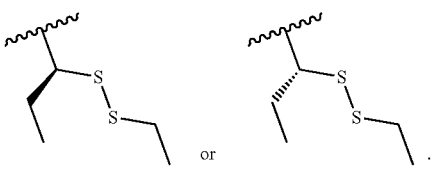

In embodiments, the reversible terminator is

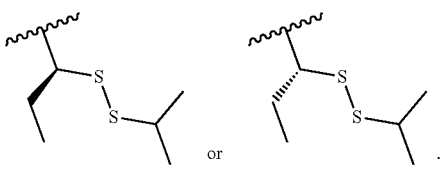

In embodiments, the reversible terminator is

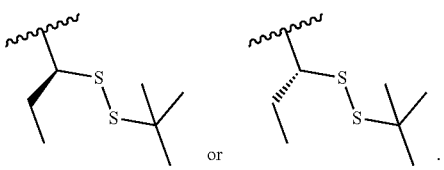

In embodiments, the reversible terminator is

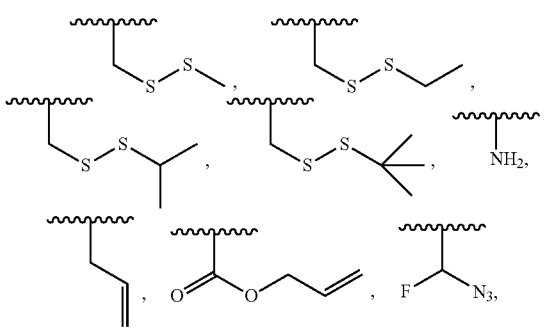

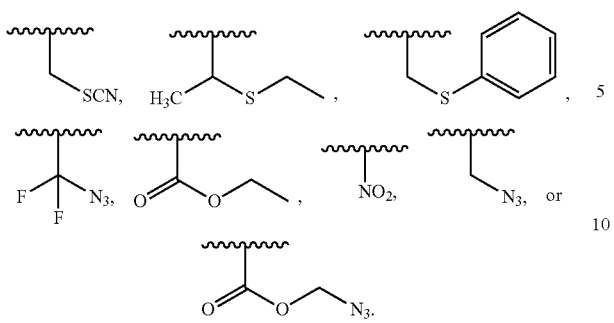

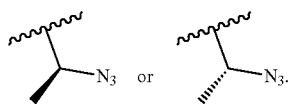

In embodiments, the reversible terminator is

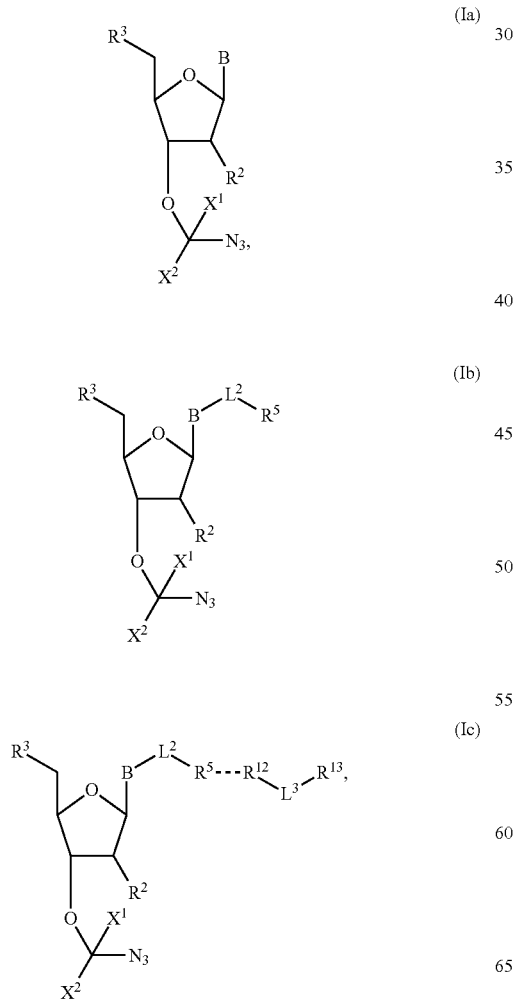

In embodiments, the modified nucleotide (e.g., also referred to herein as a nucleotide analogue) has the formula:

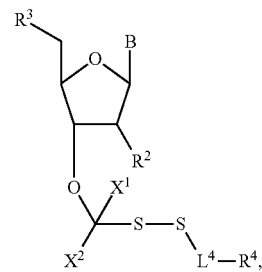

(IIa)

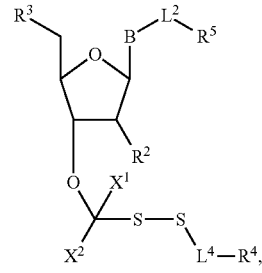

(IIb)

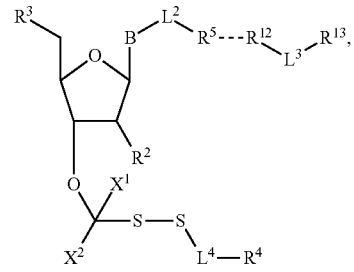

(IIc)

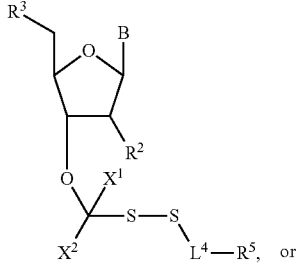

(IIIa)

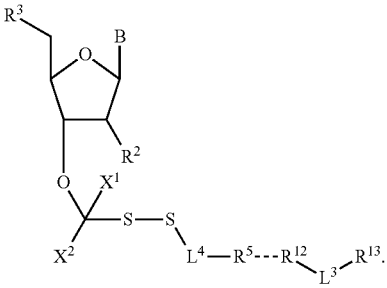

(IIIb)

The symbol "----" is a non-covalent bond. The symbol B is a base or analogue thereof. $L^2$ is a covalent linker (e.g., a cleavable linker). $L^3$ is a covalent linker. $L^4$ is a bond, substituted or unsubstituted alkylene, substituted or unsubstituted heteroalkylene, substituted or unsubstituted cycloalkylene, substituted or unsubstituted heterocycloalkylene, substituted or unsubstituted arylene, or substituted or unsubstituted heteroarylene. $R^2$ is hydrogen or —$OR^{2A}$, wherein $R^{2A}$ is hydrogen, polymerase-compatible moiety, or polymerase-compatible cleavable moiety. $R^3$ is —OH, monophosphate, or polyphosphate or a nucleic acid. $R^4$ is substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl. $R^5$ is a detectable label, an anchor moiety, or affinity anchor moiety. $R^{12}$ is a complementary affinity anchor moiety binder. $R^{13}$ is a detectable label. The symbols $X^1$ and $X^2$ are independently hydrogen, halogen, —$N_3$, or —CN, wherein at least wherein at least one of $X^1$ or $X^2$ is halogen, —$N_3$, or —CN. In embodiments, at least one of $X^1$ or $X^2$ is halogen. In embodiments, if $X^1$ is —$N_3$ then $X^2$ is not —$N_3$ for formula (Ia), (Ib), and (Ic).

In embodiments, the nucleotide analogue has the formula:

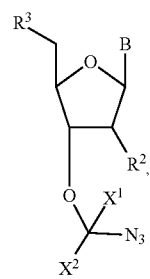

(Ia)

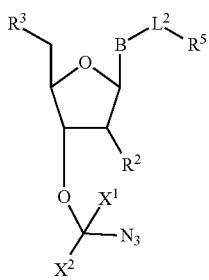

(Ib)

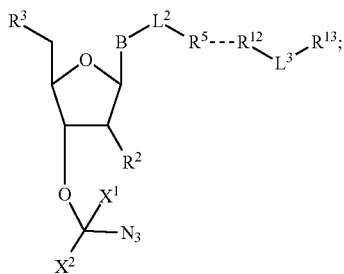

(Ic)

wherein $R^3$, B, $R^2$, $X^1$, $X^2$, $L^2$, $R^5$, $R^{12}$, $L^3$ and $R^{13}$ are as described herein, including embodiments.

In embodiments, the nucleotide analogue has the formula:

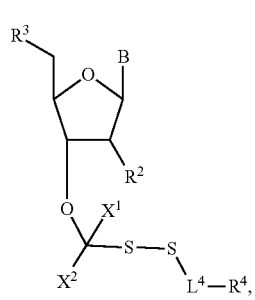

(IIa)

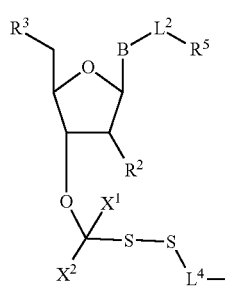

(IIb)

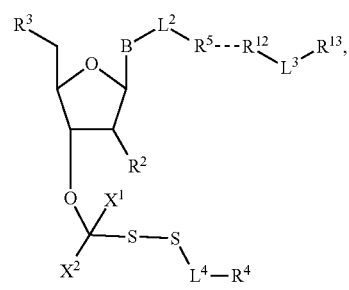

(IIc)

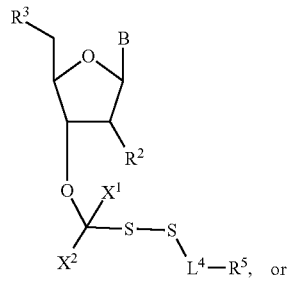

(IIIa)

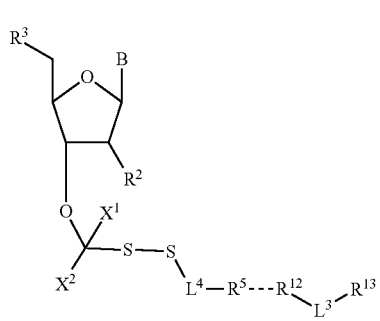

(IIIb)

wherein $R^3$, B, $R^2$, $X^1$, $X^2$, $L^2$, $L^4$, $R^4$, $R^5$, $R^{12}$, $L^3$, and $R^{13}$ are as described herein, including embodiments.

In embodiments, the nucleotide analogue has the formula:

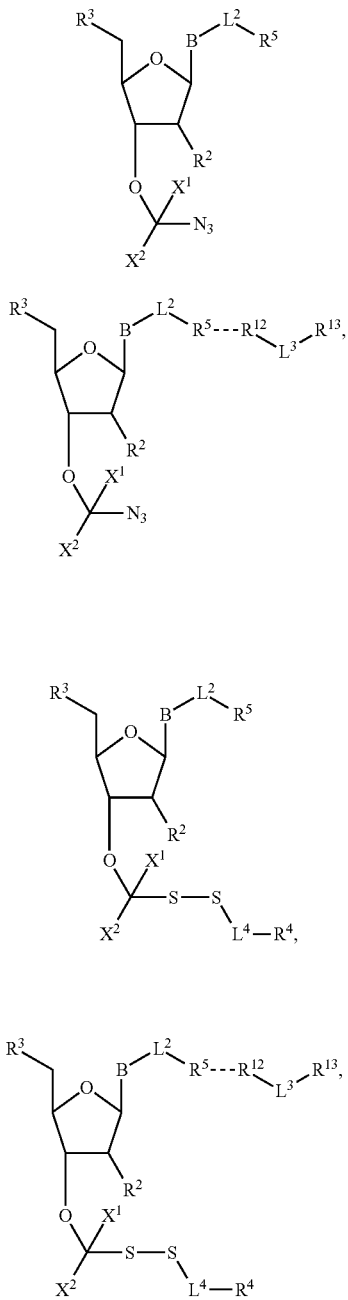

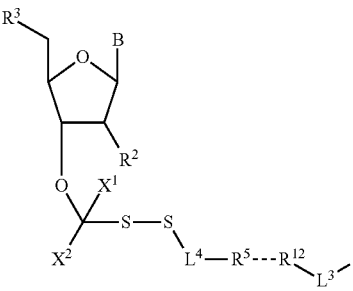

wherein $R^3$, B, $R^2$, $X^1$, $X^2$, $L^2$, $L^4$, $R^4$, $R^5$, $R^{12}$, $L^3$, and $R^{13}$ are as described herein, including embodiments.

In embodiments, the nucleotide analogue has the formula:

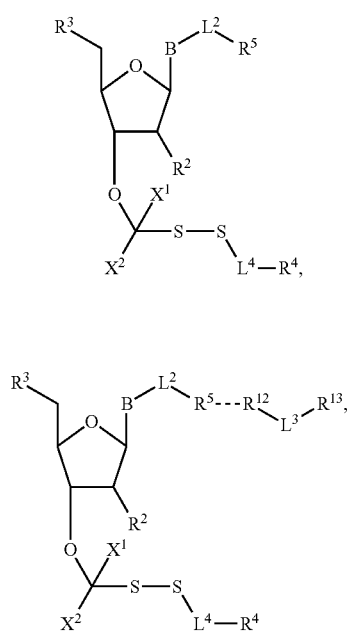

wherein $R^3$, B, $R^2$, $X^1$, and $X^2$ are as described herein, including embodiments. In embodiments, the nucleotide analogue has the formula:

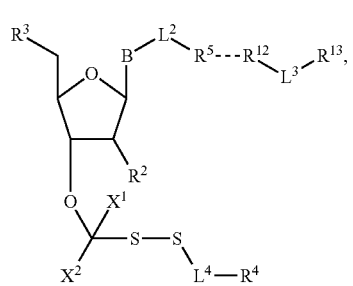

wherein $R^3$, B, $L^2$, $R^5$, $R^2$, $X^1$, and $X^2$ are as described herein, including embodiments. In embodiments, the nucleotide analogue has the formula:

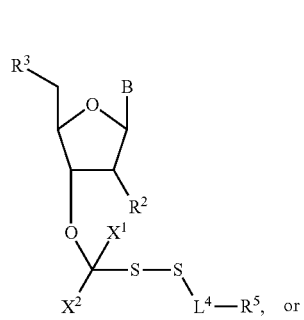

wherein $R^3$, B, $L^2$, $R^5$, $R^{12}$, $L^3$, $R^{13}$, $R^2$, $X^1$, and $X^2$ are as described herein, including embodiments. In embodiments, the nucleotide analogue has the formula:

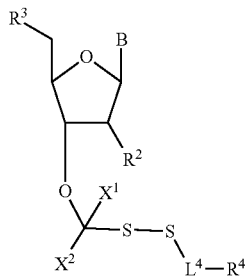
(IIa)

wherein $R^3$, B, $R^2$, $X^1$, $X^2$, L4, and R4 are as described herein, including embodiments. In embodiments, the nucleotide analogue has the formula:

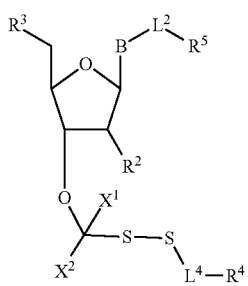
(IIb)

wherein $R^3$, B, $L^2$, $R^5$, $R^2$, $X^1$, $X^2$, $L^4$, and $R^4$ are as described herein, including embodiments. In embodiments, the nucleotide analogue has the formula:

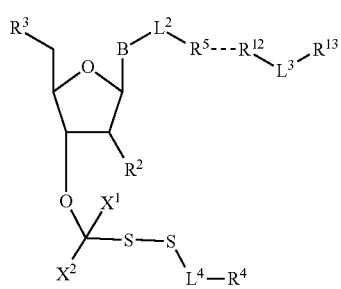
(IIc)

wherein $R^3$, B, $L^2$, $R^5$, $R^{12}$, $L^3$, $R^{13}$, $R^2$, $X^1$, $X^2$, $L^4$ and $R^4$ are as described herein, including embodiments. In embodiments, the nucleotide analogue has the formula:

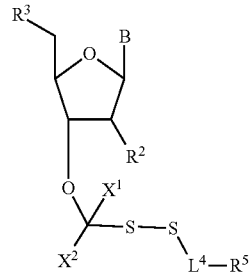
(IIIa)

wherein $R^3$, B, $R^2$, $X^1$, $X^2$, $L^4$ and $R^5$ are as described herein, including embodiments. In embodiments, the nucleotide analogue has the formula:

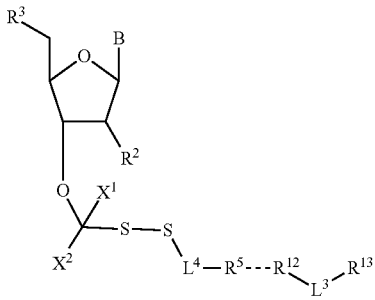
(IIIb)

wherein $R^3$, B, $R^2$, $X^1$, $X^2$, $L^4$, $R^5$, $R^{12}$, $L^3$, and $R^{13}$ are as described herein, including embodiments.

In embodiments, B is

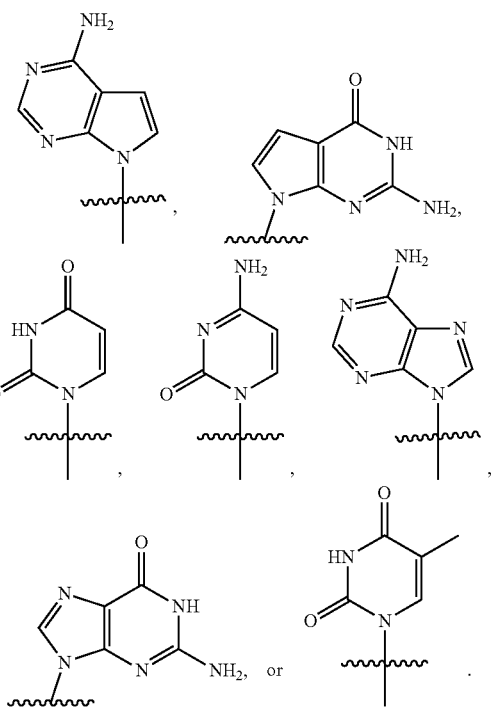

In embodiments, B is
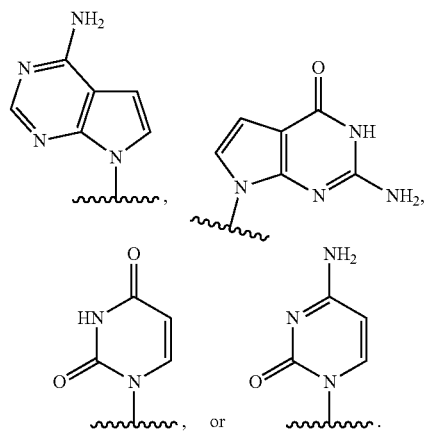
In embodiments, B is
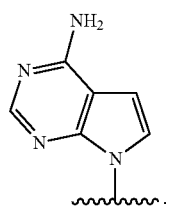 [SMILES: *n1ccc2c(N)ncnc21]
In embodiments, B is
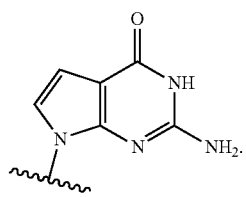 [SMILES: *n1ccc2c(=O)[nH]c(N)nc21]
In embodiments, B is
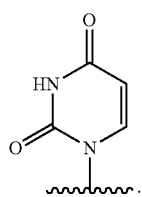 [SMILES: *n1ccc(=O)[nH]c1=O]
In embodiments, B¹ is
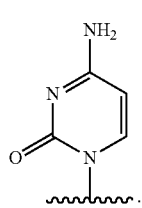 [SMILES: *n1ccc(N)nc1=O]
In embodiments, B is
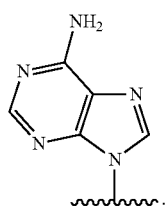 [SMILES: *n1cnc2c(N)ncnc21]
In embodiments, B is
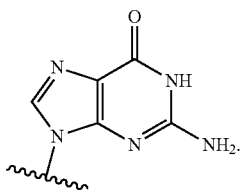 [SMILES: *n1cnc2c(=O)[nH]c(N)nc21]
In embodiments, B is
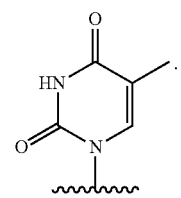 [SMILES: *n1cc(C)c(=O)[nH]c1=O]
In embodiments, B is
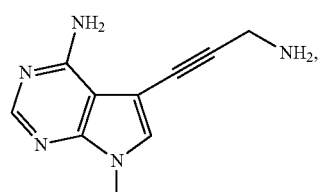
In embodiments, B is
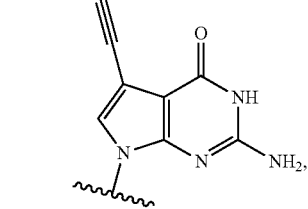
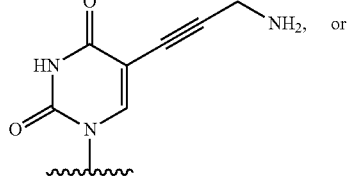

-continued

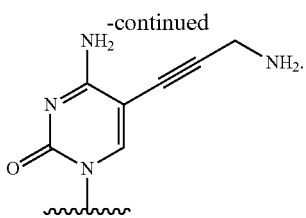

In embodiments, B is

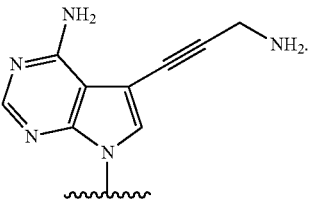 [SMILES: *n1cc(C#CCN)c2c(N)ncnc21]

In embodiments, B is

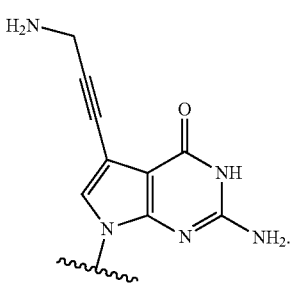 [SMILES: *n1cc(C#CCN)c2c(=O)[nH]c(N)nc21]

In embodiments, B is

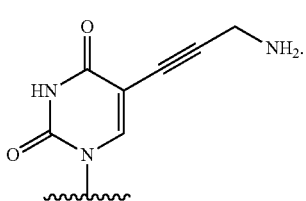 [SMILES: *n1cc(C#CCN)c(=O)[nH]c1=O]

In embodiments, B is

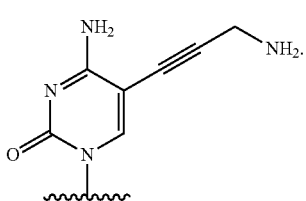 [SMILES: *n1cc(C#CCN)c(N)nc1=O]

In embodiments, $R^3$ is a monophosphate moiety. In embodiments, $R^3$ is a triphosphate moiety.

In embodiments, $X^1$ is hydrogen. In embodiments, $X^1$ is halogen (e.g., —F). In embodiments, $X^1$ is —CN. In embodiments, $X^1$ is —N$_3$. In embodiments, $X^2$ is hydrogen. In embodiments, $X^2$ is halogen (e.g., —F). In embodiments, $X^2$ is —CN. In embodiments, $X^2$ is —N$_3$.

In embodiments, $X^1$ is hydrogen, and $X^2$ is halogen. In embodiments, $X^1$ is hydrogen, and $X^2$ is —CN. In embodiments, $X^1$ is hydrogen, and $X^2$ is —N$_3$. In embodiments, $X^1$ is halogen, and $X^2$ is hydrogen. In embodiments, $X^1$ is halogen, and $X^2$ is halogen. In embodiments, $X^1$ is halogen, and $X^2$ is —CN. In embodiments, $X^1$ is halogen, and $X^2$ is —N$_3$. In embodiments, $X^1$ is —CN, and $X^2$ is hydrogen. In embodiments, $X^1$ is —CN, and $X^2$ is halogen. In embodiments, $X^1$ is —CN, and $X^2$ is —CN. In embodiments, $X^1$ is —CN, and $X^2$ is —N$_3$. In embodiments, $X^1$ is —N$_3$, and $X^2$ is hydrogen. In embodiments, $X^1$ is —N$_3$, and $X^2$ is halogen. In embodiments, $X^1$ is —N$_3$, and $X^2$ is —CN. In embodiments, $X^1$ is —N$_3$, and $X^2$ is —N$_3$.

In embodiments, $X^1$ is hydrogen, and $X^2$ is —F. In embodiments, $X^1$ is hydrogen, and $X^2$ is —CN. In embodiments, $X^1$ is hydrogen, and $X^2$ is —N$_3$. In embodiments, $X^1$ is —F, and $X^2$ is hydrogen. In embodiments, $X^1$ is —F, and $X^2$ is —F. In embodiments, $X^1$ is —F, and $X^2$ is —CN. In embodiments, $X^1$ is —F, and $X^2$ is —N$_3$. In embodiments, $X^1$ is —CN, and $X^2$ is hydrogen. In embodiments, $X^1$ is —CN, and $X^2$ is —F. In embodiments, $X^1$ is —CN, and $X^2$ is —CN. In embodiments, $X^1$ is —CN, and $X^2$ is —N$_3$. In embodiments, $X^1$ is —N$_3$, and $X^2$ is hydrogen. In embodiments, $X^1$ is —N$_3$, and $X^2$ is —F. In embodiments, $X^1$ is —N$_3$, and $X^2$ is —CN. In embodiments, $X^1$ is —N$_3$, and $X^2$ is —N$_3$.

In embodiments, $X^1$ is H and $X^2$ is —N$_3$. In embodiments, $X^1$ is H and $X^2$ is —CN. In embodiments, $X^1$ is H and $X^2$ is —F. In embodiments, $X^1$ is —F and $X^2$ is —F. In embodiments, $X^1$ is —N$_3$ and $X^2$ is —N$_3$. In embodiments, $X^1$ is —N$_3$ and $X^2$ is —N$_3$. In embodiments, $X^1$ is —N$_3$ and $X^2$ is —CN. In embodiments, $X^1$ is —CN and $X^2$ is —CN.

In embodiments, $X^1$ is H and $X^2$ is —N$_3$ for formula (Ia), (Ib), and (Ic). In embodiments, $X^1$ is H and $X^2$ is —CN for formula (Ia), (Ib), and (Ic). In embodiments, $X^1$ is H and $X^2$ is —F for formula (Ia), (Ib), and (Ic). In embodiments, $X^1$ is —F and $X^2$ is —F for formula (Ia), (Ib), and (Ic). In embodiments, $X^1$ is —N$_3$ and $X^2$ is —N$_3$ for formula (Ia), (Ib), and (Ic). In embodiments, $X^1$ is —N$_3$ and $X^2$ is —N$_3$ for formula (Ia), (Ib), and (Ic). In embodiments, $X^1$ is —N$_3$ and $X^2$ is —CN for formula (Ia), (Ib), and (Ic). In embodiments, $X^1$ is —CN and $X^2$ is —CN for formula (Ia), (Ib), and (Ic).

In embodiments, $X^1$ is not —N$_3$ and $X^2$ is not —N$_3$ for formula (Ia), (Ib), and (Ic). In embodiments, $X^1$ is not —CN and $X^2$ is not —N$_3$ for formula (Ia), (Ib), and (Ic). In embodiments, $X^1$ is not —CN and $X^2$ is not —CN for formula (Ia), (Ib), and (Ic).

In embodiments, $X^1$ is not —N$_3$ and $X^2$ is not —N$_3$ for formula (IIa), (IIb), (IIc), (IIIa), or (IIIb). In embodiments, $X^1$ is not —N$_3$ and $X^2$ is not —CN for formula (IIa), (IIb), (IIc), (IIIa), or (IIIb). In embodiments, $X^1$ is not —CN and $X^2$ is not —CN for formula (IIa), (IIb), (IIc), (IIIa), or (IIIb).

In embodiments, $L^2$ is a cleavable linker. In embodiments, $L^2$ is a non-cleavable linker. In embodiments, $L^2$ is a chemically cleavable linker. In embodiments, $L^2$ is a photocleavable linker, an acid-cleavable linker, a base-cleavable linker, an oxidant-cleavable linker, a reductant-cleavable linker, or a fluoride-cleavable linker. In embodiments, $L^2$ is a cleavable linker comprising a dialkylketal linker, an azo linker, an allyl linker, a cyanoethyl linker, a 1-(4,4-dimethyl-2,6-dioxocyclohex-1-ylidene)ethyl linker, or a nitrobenzyl linker.

In embodiments, $L^2$ is a bond, substituted or unsubstituted alkylene, substituted or unsubstituted heteroalkylene, substituted or unsubstituted cycloalkylene, substituted or unsubstituted heterocycloalkylene, substituted or unsubstituted arylene, or substituted or unsubstituted heteroarylene.

In embodiments, $L^2$ is —C(CH$_3$)$_2$CH$_2$NHC(O)—,

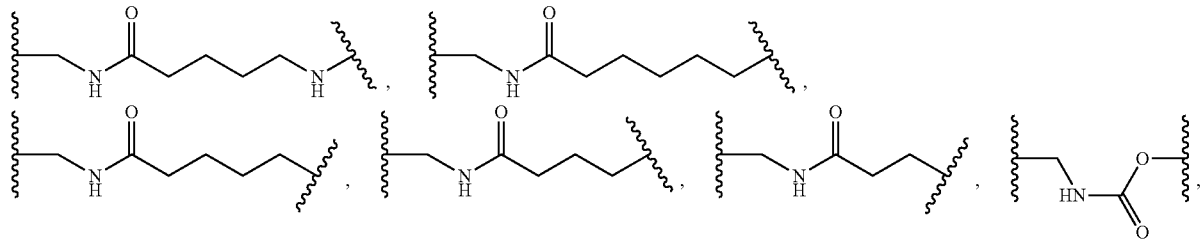

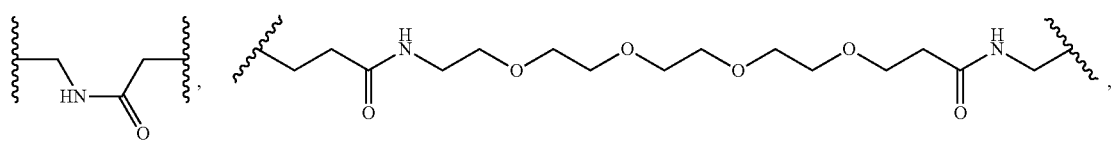

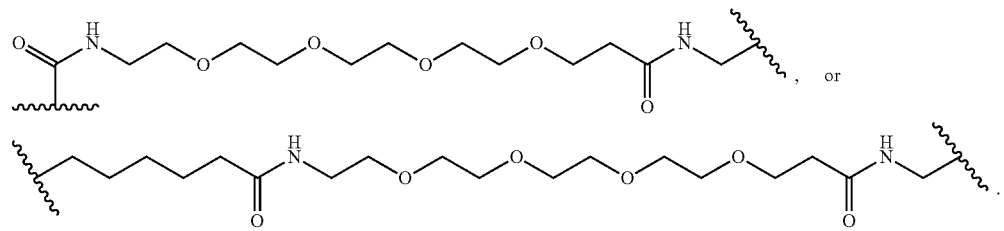

In embodiments, $L^2$ is

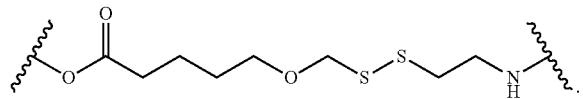 [SMILES: *NCCSSCOCCCCC(=O)O*]

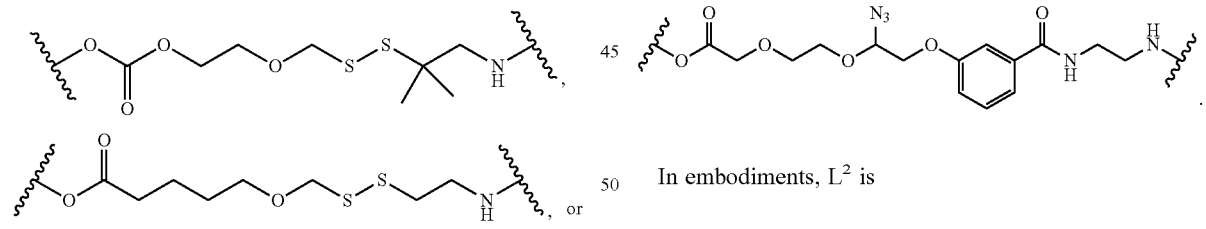

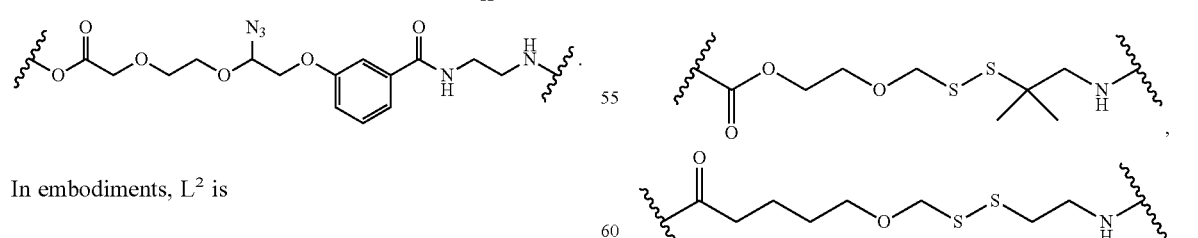

In embodiments, $L^2$ is

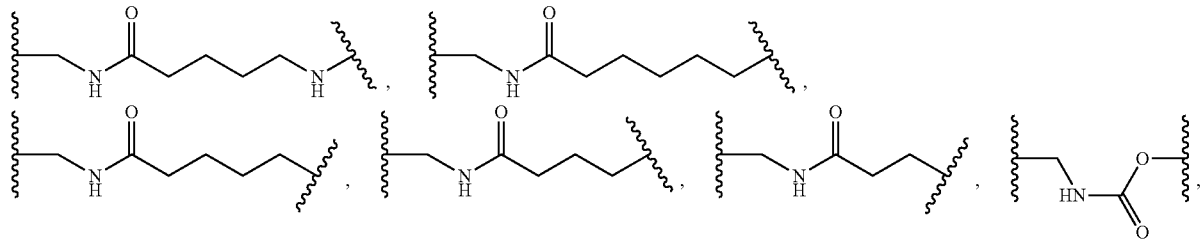

In embodiments, $L^2$ is

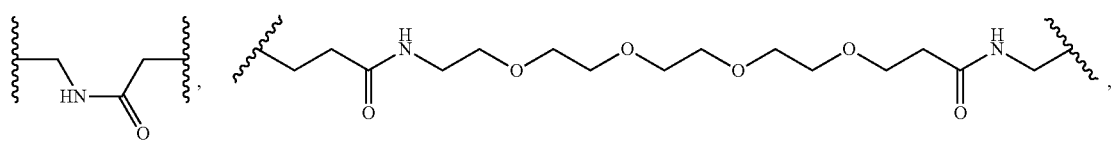

In embodiments, $L^2$ is

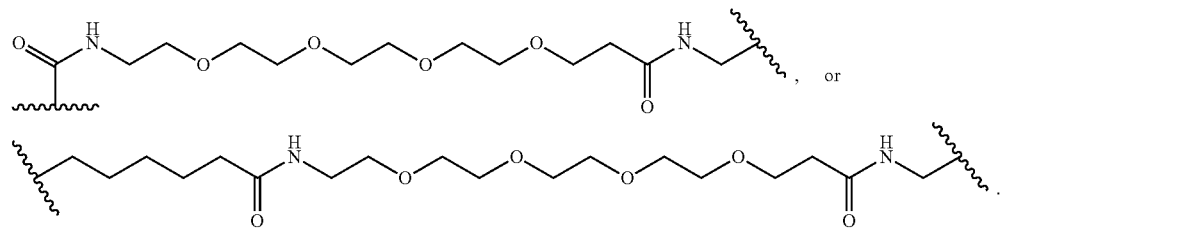

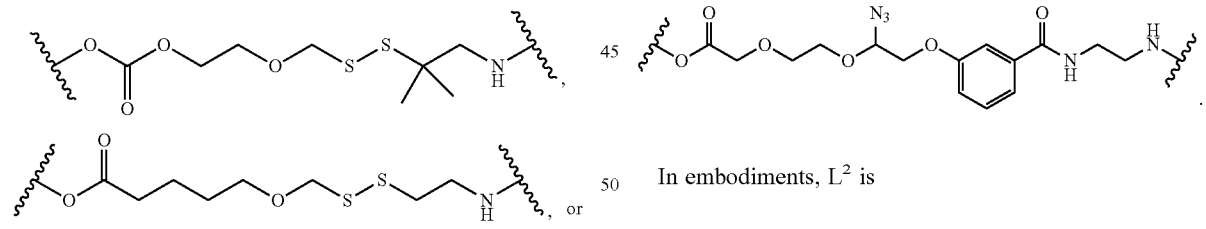

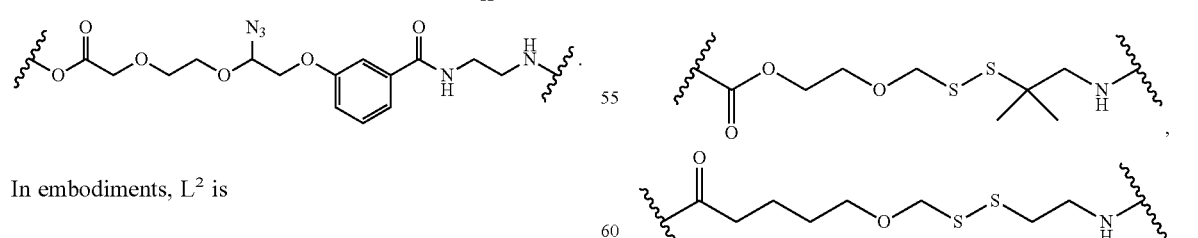

In embodiments, L² is
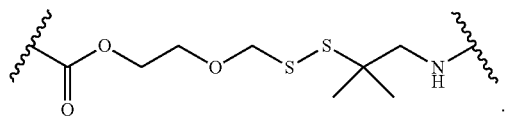 [SMILES: *NCC(C)(C)SSCOCCOC(*)=O]
In embodiments, L² is
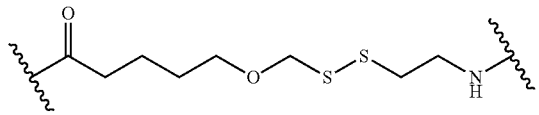
In embodiments, L² is
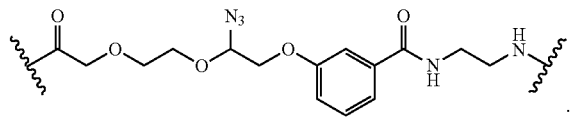 [SMILES: *NCCNC(=O)c1cccc(OCC(N=[N+]=[N-])OCCOCC(*)=O)c1]
In embodiments, L² is
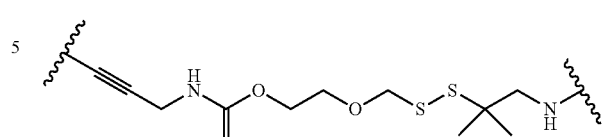
In embodiments, L² is
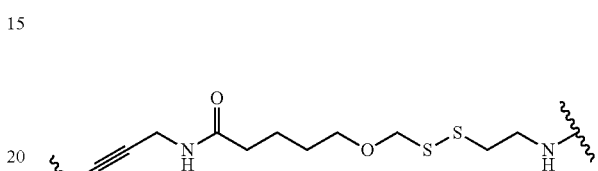
In embodiments, L² is
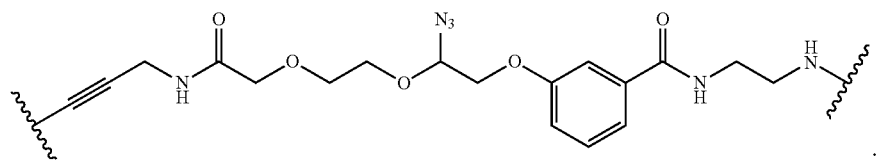 [SMILES: *C#CCNC(=O)COCCOC(COc1cccc(C(=O)NCCN*)c1)N=[N+]=[N-]]
In embodiments, L² is
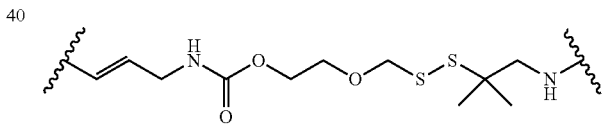
In embodiments, L² is
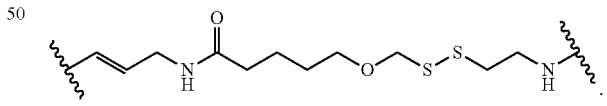
In embodiments, L² is
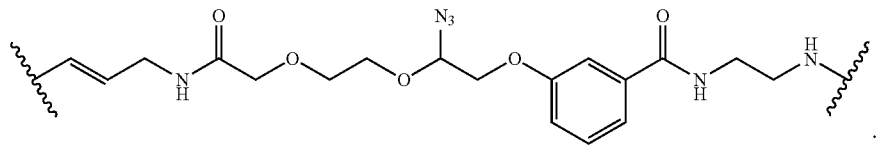 [SMILES: */C=C/CNC(=O)COCCOC(COc1cccc(C(=O)NCCN*)c1)N=[N+]=[N-]]

In embodiments, L² is
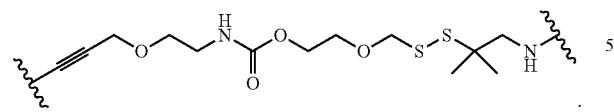
In embodiments, L² is
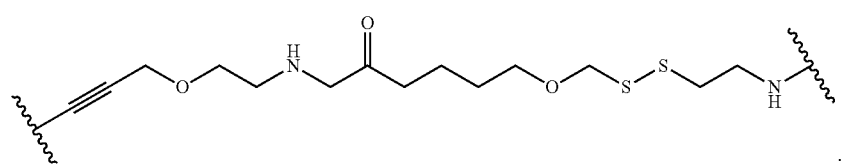 [SMILES: *C#CCOCCNCC(=O)CCCCOCSSCCN*]
In embodiments, L² is
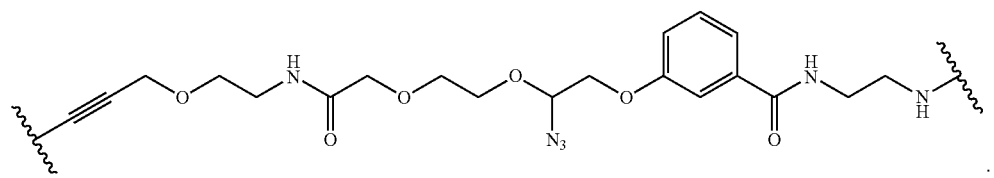 [SMILES: *C#CCOCCNC(=O)COCCOC(COc1cccc(C(=O)NCCN*)c1)N=[N+]=[N-]]
In embodiments, L² is
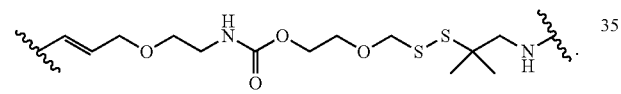
In embodiments, L² is
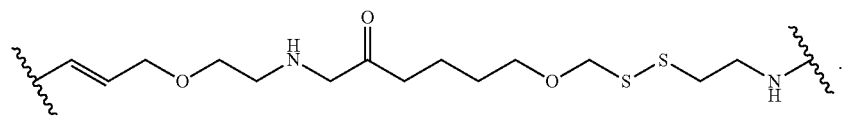 [SMILES: */C=C/COCCNCC(=O)CCCCOCSSCCN*]
In embodiments, L² is
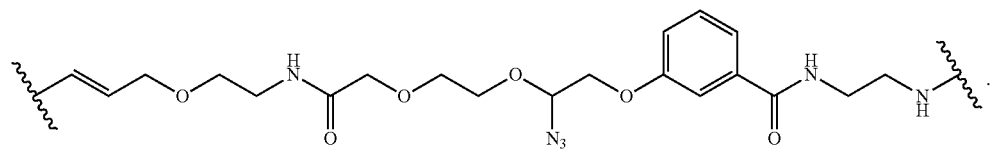 [SMILES: */C=C/COCCNC(=O)COCCOC(COc1cccc(C(=O)NCCN*)c1)N=[N+]=[N-]]
In embodiments, L² is
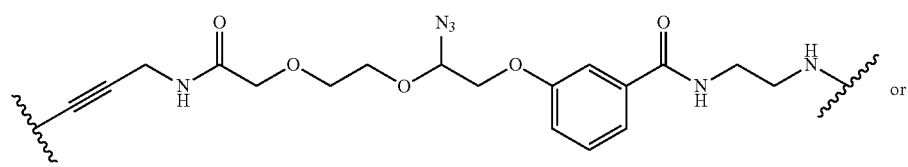 or -continued
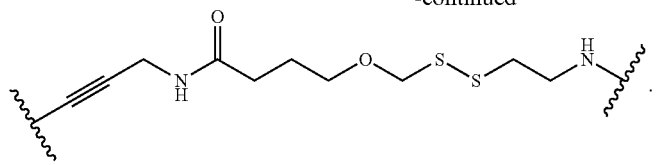
In embodiments, $L^2$ is
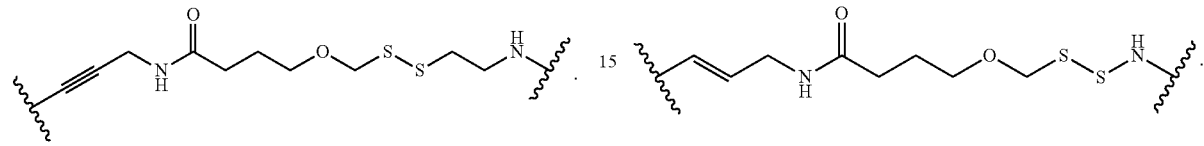
In embodiments, $L^2$ is
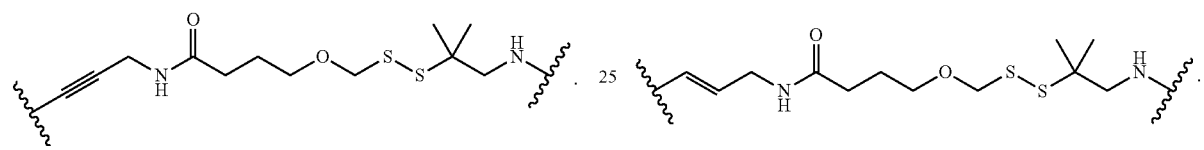
In embodiments, $L^2$ is
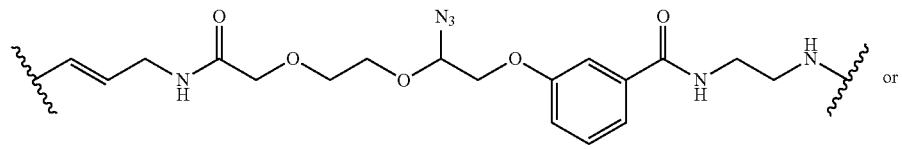
In embodiments, $L^2$ is
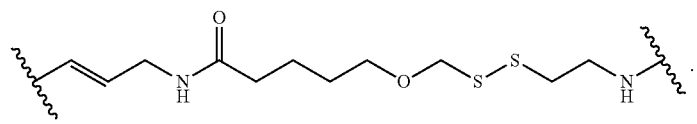
In embodiments, $L^2$ is
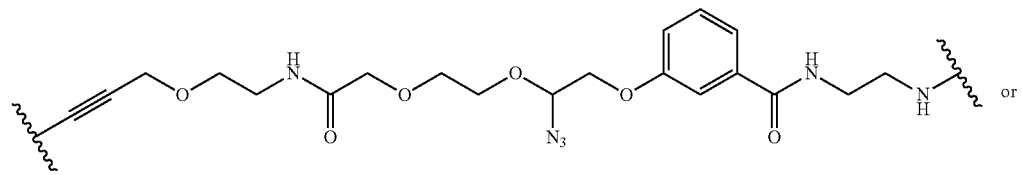
or
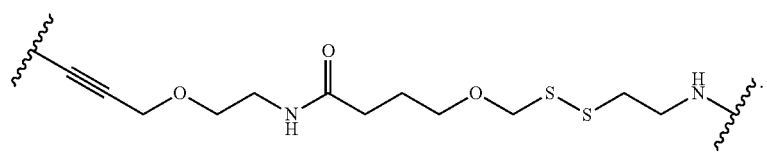
In embodiments, $L^2$ is In embodiments, L² is
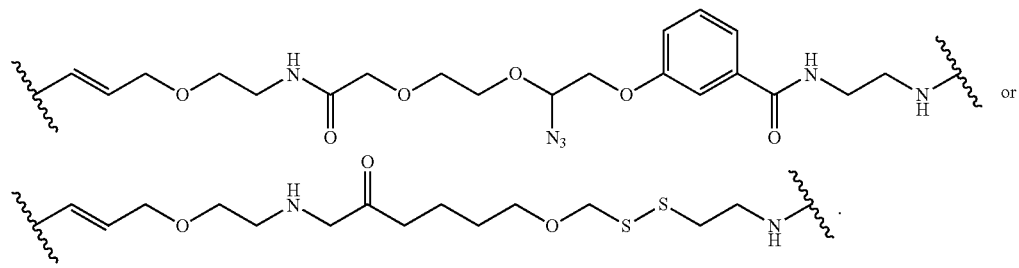 or
In embodiments, L² is
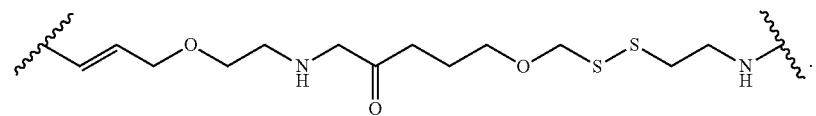 [SMILES: */C=C/COCCNCC(=O)CCCOCSSCCN*]
In embodiments, L² is
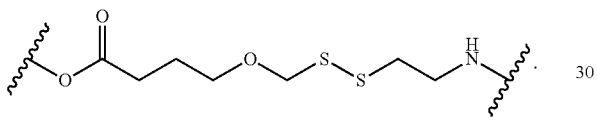
In embodiments, L² is
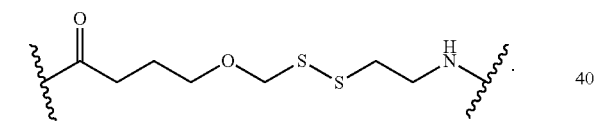
In embodiments, -L²-R⁵ is
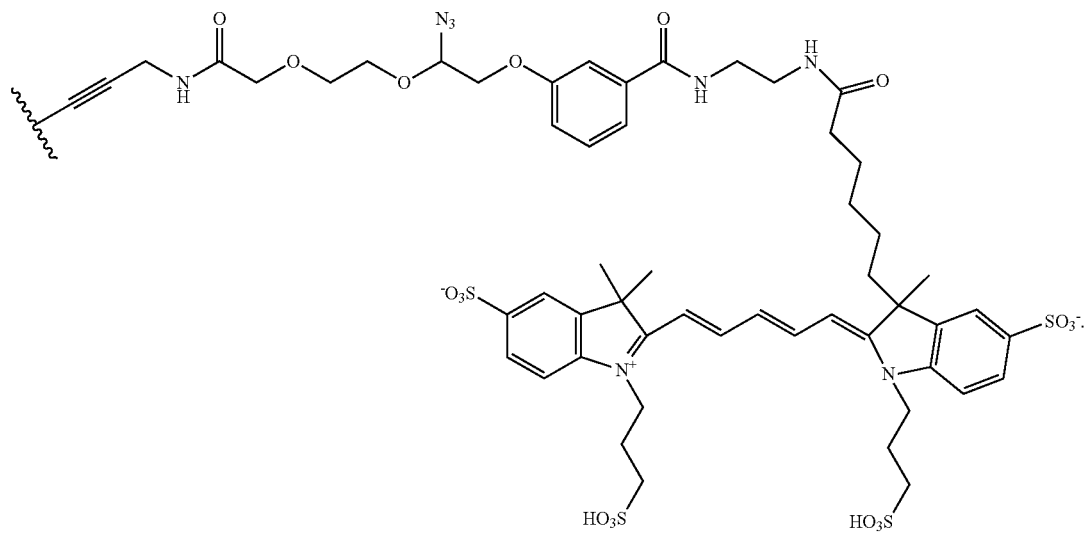

In embodiments, -$L^2$-$R^5$ is
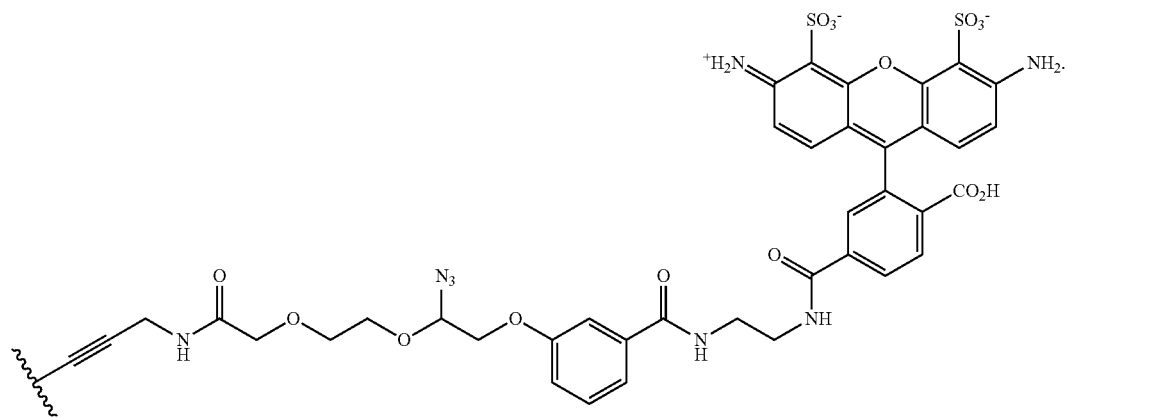
20
In embodiments, -$L^2$-$R^5$ is
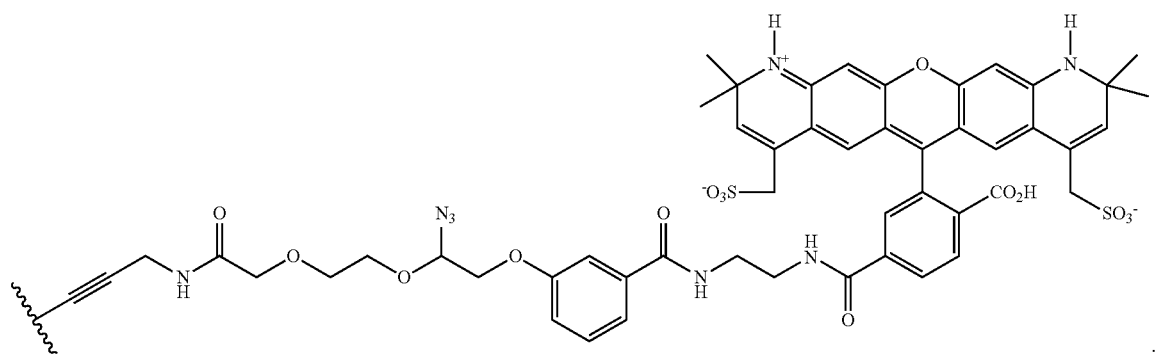
In embodiments, -$L^2$-$R^5$ is
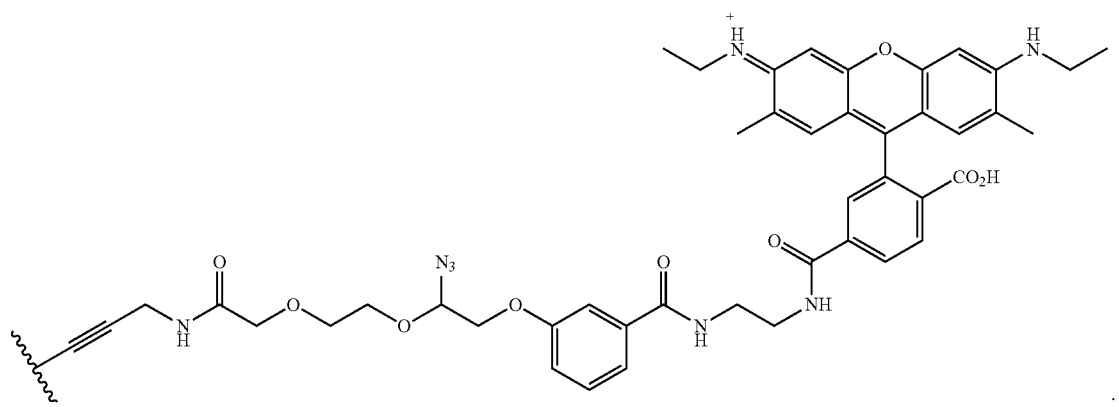

In embodiments, -L²-R⁵ is
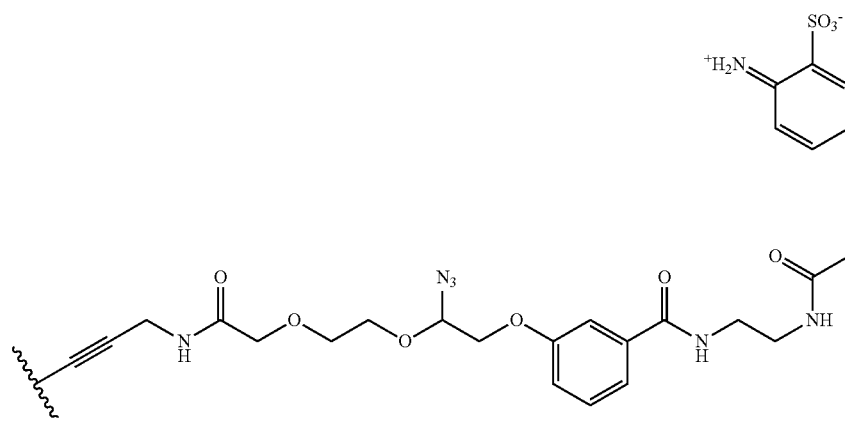
In embodiments, R⁵ is a streptavidin moiety. In embodiments, R⁵ is an anchor moiety, or affinity anchor moiety. In embodiments, R⁵ is an anchor moiety. In embodiments, R⁵ is an affinity anchor moiety.
In embodiments, R⁵ is
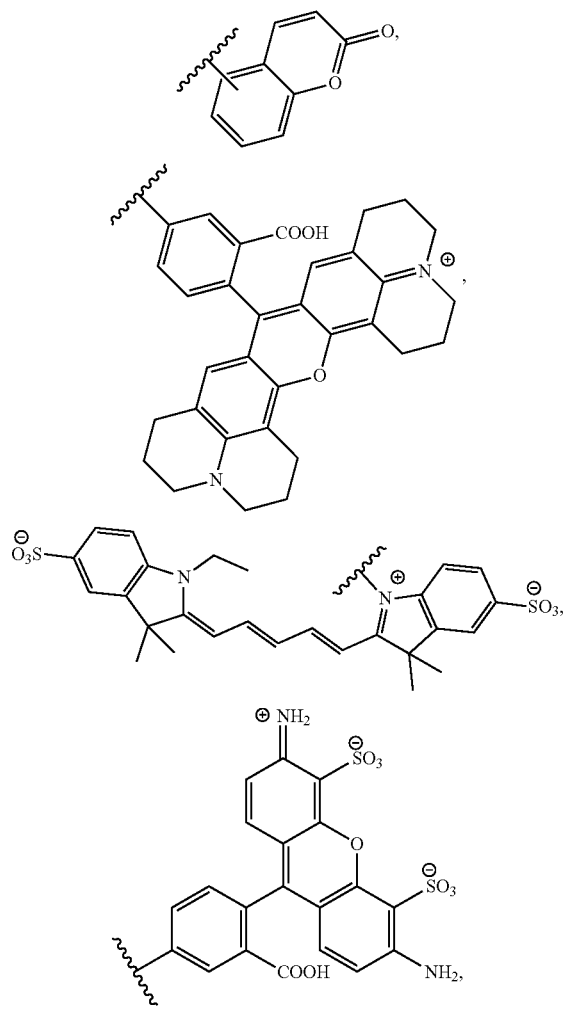
-continued
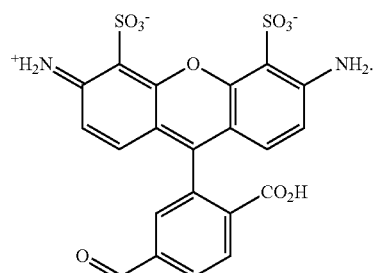
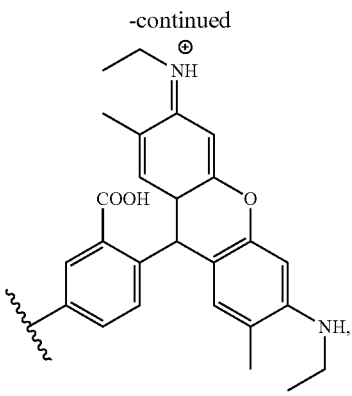
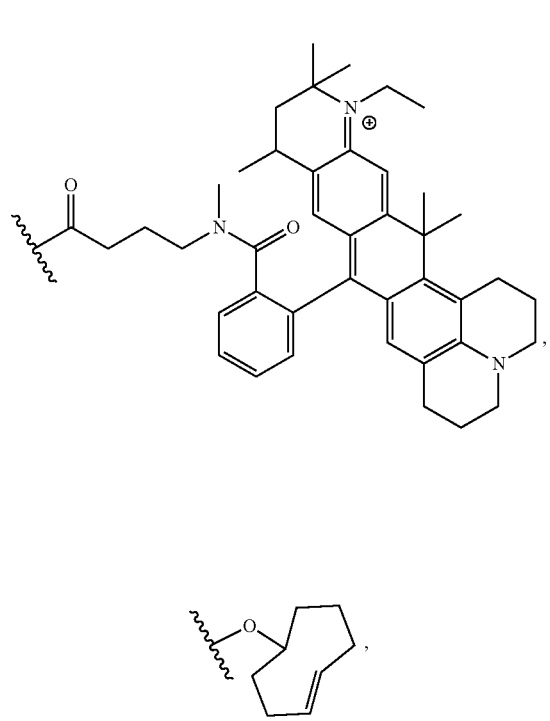

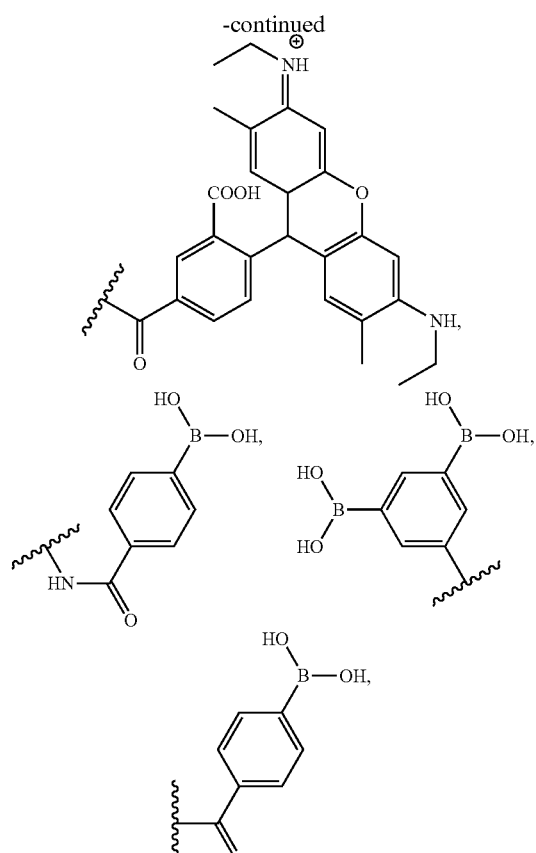
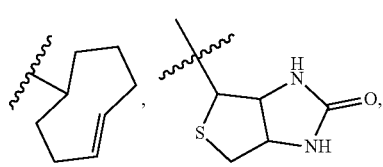 [SMILES: *C1CC/C=C/CCC1 ; *C1SCC2NC(=O)NC21]
unsubstituted ethynyl,
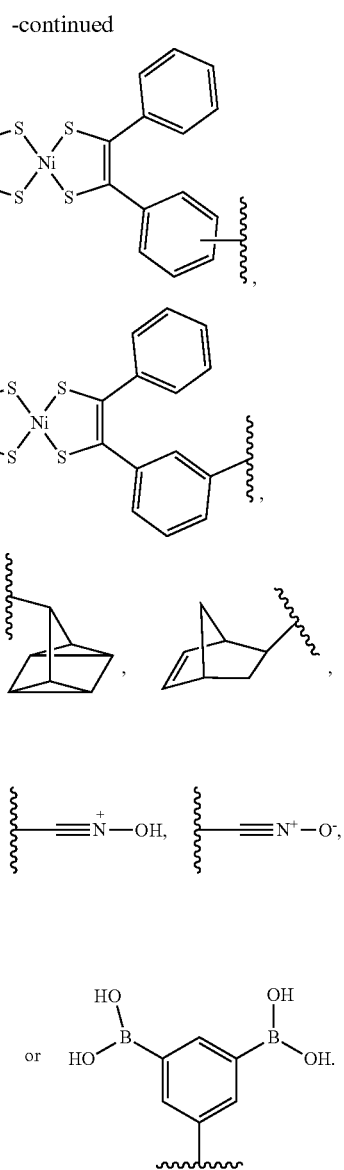
In embodiments, R⁵ is
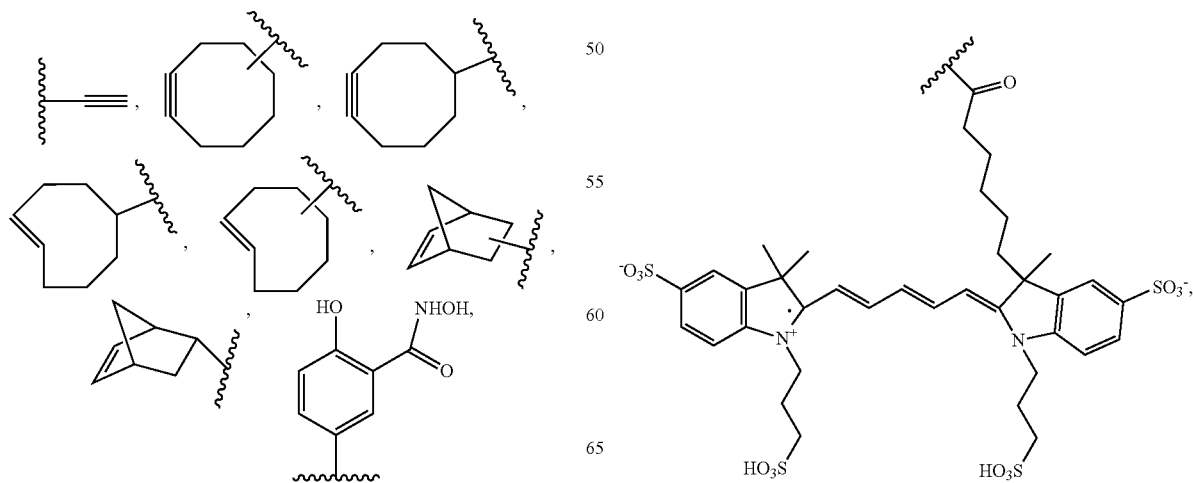

-continued

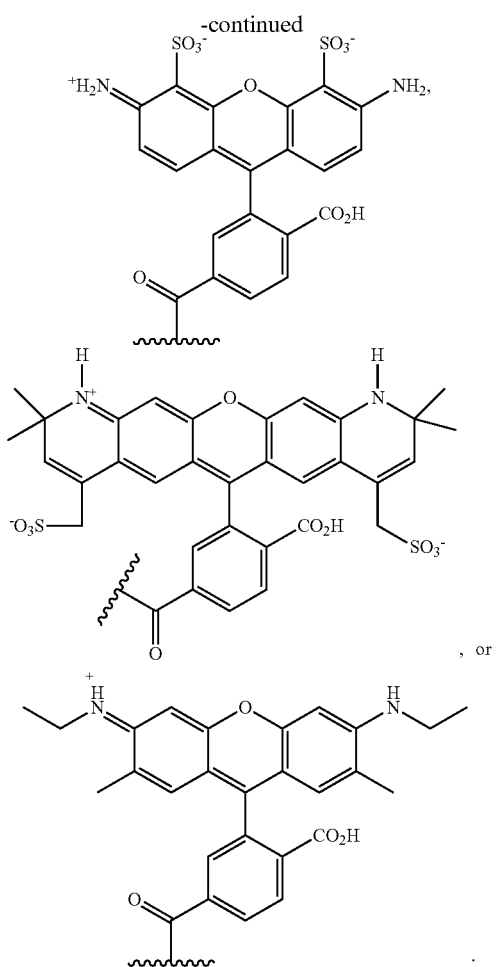

In embodiments, $R^5$ is a detectable label. In embodiments, $R^5$ is a fluorescent dye. In embodiments, $R^5$ is an anchor moiety. In embodiments, $R^5$ is a click chemistry reactant moiety. In embodiments, $R^5$ is a trans-cyclooctene moiety or azide moiety. In embodiments, $R^5$ is an affinity anchor moiety. In embodiments, $R^5$ is a biotin moiety. In embodiments, $R^5$ is a reactant for a bioconjugate reaction that forms a covalent bond between $R^5$ and a second bioconjugate reaction reactant (e.g., $R^{12}$).

In embodiments, $R^5$ is a fluorescent dye. In embodiments $R^5$ is a Alexa Fluor® 350 moiety, Alexa Fluor® 405 moiety, Alexa Fluor® 430 moiety, Alexa Fluor® 488 moiety, Alexa Fluor® 532 moiety, Alexa Fluor® 546 moiety, Alexa Fluor® 555 moiety, Alexa Fluor® 568 moiety, Alexa Fluor® 594 moiety, Alexa Fluor® 610 moiety, Alexa Fluor® 633 moiety, Alexa Fluor® 635 moiety, Alexa Fluor® 647 moiety, Alexa Fluor® 660 moiety, Alexa Fluor® 680 moiety, Alexa Fluor® 700 moiety, Alexa Fluor® 750 moiety, or Alexa Fluor® 790 moiety. In embodiments the detectable moiety is a Alexa Fluor® 488 moiety, Rhodamine 6G (R6G) moiety, ROX Reference Dye (ROX) moiety, or Cy5 moiety.

In embodiments $R^5$ is a FAM™ moiety, TET™ moiety, JOE™ moiety, VIC® moiety, HEX™ moiety, NED™ moiety, PET® moiety, ROX™ moiety, TAMRA™ moiety, TET™ moiety, Texas Red® moiety, Alexa Fluor® 488 moiety, Rhodamine 6G (R6G) moiety, ROX Reference Dye (ROX) moiety, Sulfo-Cy5, or Cy5 moiety. In embodiments $R^5$ is a Rhodamine 6G (R6G) moiety, ROX Reference Dye (ROX) moiety, Sulfo-Cy5, or Cy5 moiety.

In embodiments, $R^5$ is a biotin moiety. In embodiments, $R^5$ is a biotin moiety and $R^{12}$ is a streptavidin moiety.

In embodiments, $R^5$ is

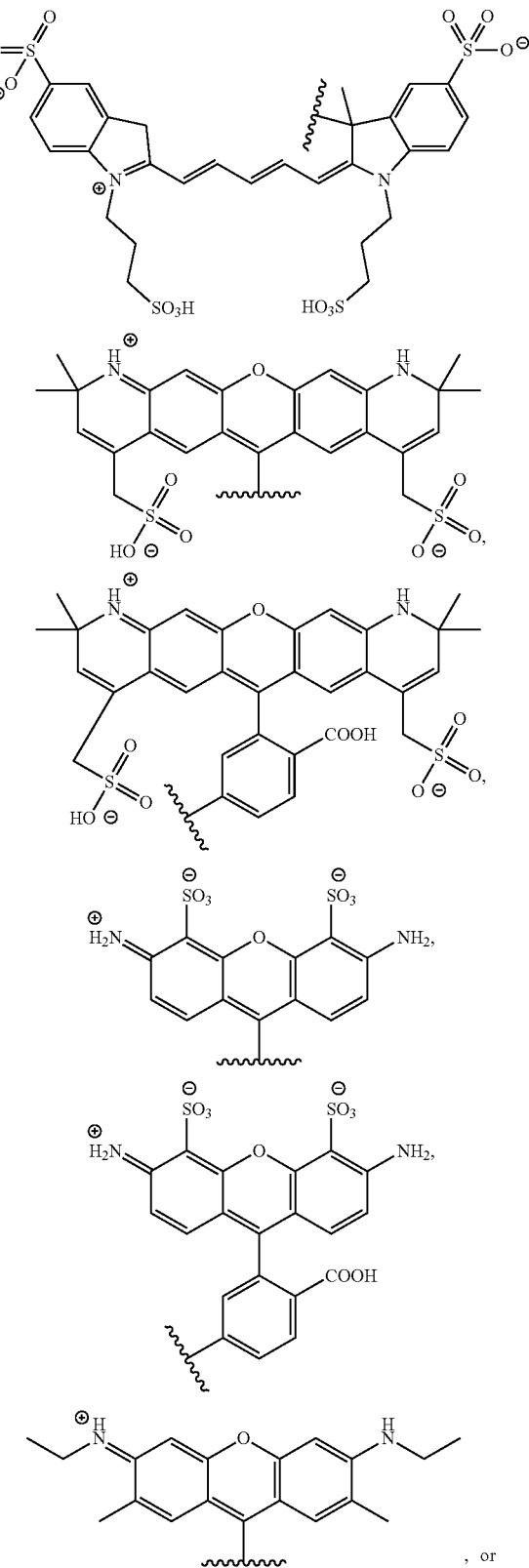

, or

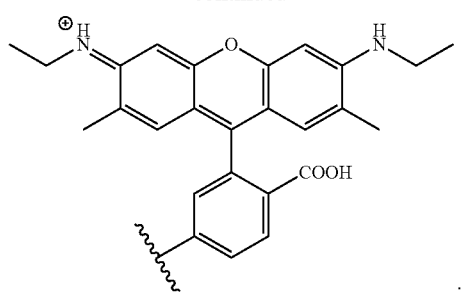
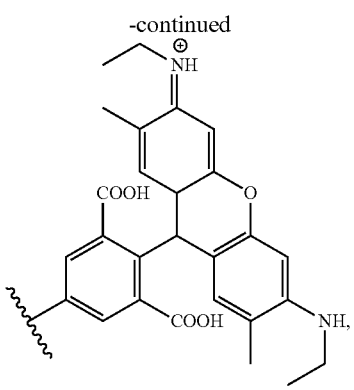
In embodiments, R[5] is
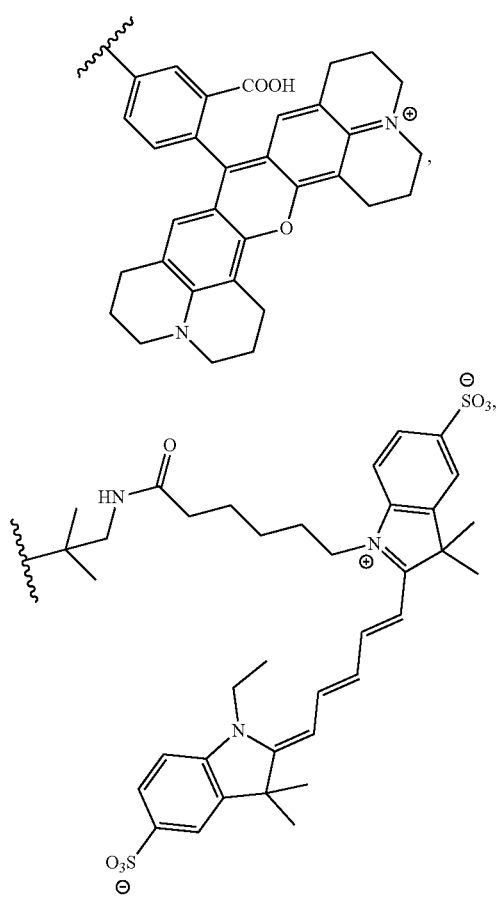
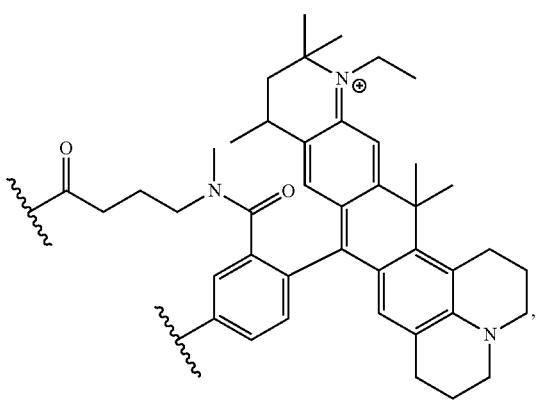
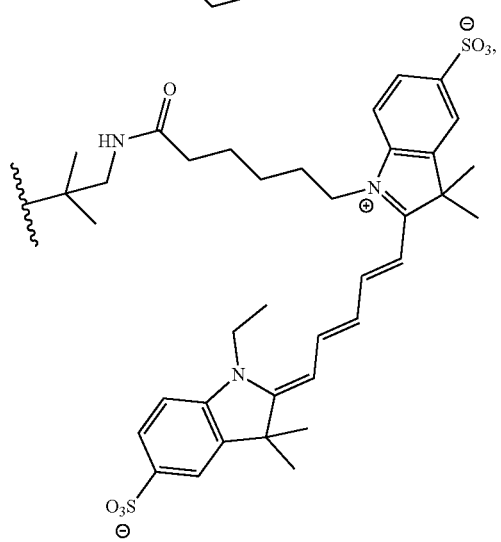
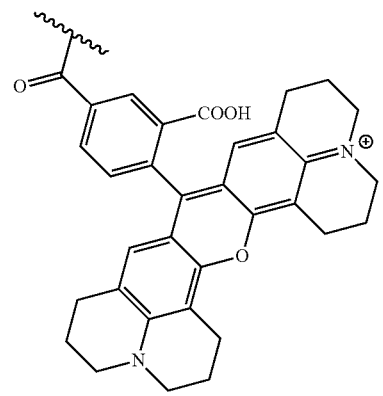
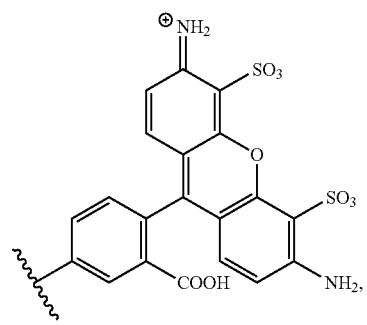
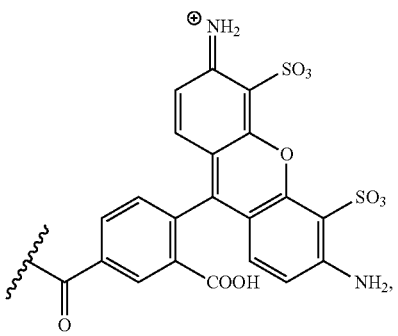

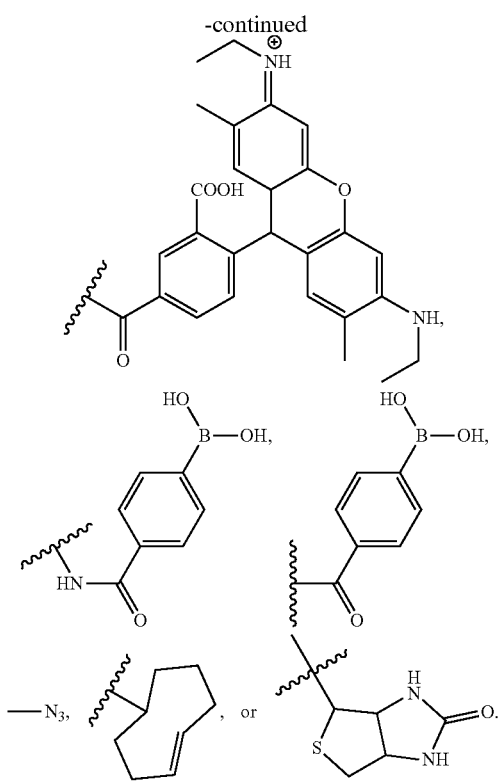

In embodiments, $L^4$ is a bond, substituted or unsubstituted alkylene, substituted or unsubstituted heteroalkylene, substituted or unsubstituted cycloalkylene, substituted or unsubstituted heterocycloalkylene, substituted or unsubstituted arylene, or substituted or unsubstituted heteroarylene. In embodiments, $L^4$ is a bond, substituted or unsubstituted $C_1$-$C_8$ alkylene, substituted or unsubstituted 2 to 8 membered heteroalkylene, substituted or unsubstituted $C_3$-$C_8$ cycloalkylene, substituted or unsubstituted 3 to 8 membered heterocycloalkylene, substituted or unsubstituted $C_6$-$C_{10}$ arylene, or substituted or unsubstituted 5 to 10 membered heteroarylene. In embodiments, $L^4$ is a substituted or unsubstituted $C_1$-$C_6$ alkylene or substituted or unsubstituted 2 to 6 membered heteroalkylene. In embodiments, $L^4$ is an unsubstituted $C_1$-$C_4$ alkylene. In embodiments, $L^4$ is a bond.

In embodiments, $L^4$ is a substituted or unsubstituted methylene. In embodiments, $L^4$ is substituted with a substituted or unsubstituted $C_1$-$C_6$ alkylene, substituted or unsubstituted 2 to 6 membered heteroalkylene, substituted or unsubstituted $C_3$-$C_6$ cycloalkylene, substituted or unsubstituted 3 to 6 membered heterocycloalkylene, substituted or unsubstituted phenyl, or substituted or unsubstituted 5 to 6 membered heteroarylene. In embodiments, $L^4$ is a bond, substituted or unsubstituted $C_1$-$C_6$ alkylene, substituted or unsubstituted 2 to 6 membered heteroalkylene, substituted or unsubstituted $C_3$-$C_6$ cycloalkylene, substituted or unsubstituted 3 to 6 membered heterocycloalkylene, substituted or unsubstituted phenyl, or substituted or unsubstituted 5 to 6 membered heteroarylene.

In embodiments, $L^4$ is substituted with a substituted or unsubstituted $C_1$-$C_6$ alkylene or substituted or unsubstituted 2 to 6 membered heteroalkylene. In embodiments, $L^4$ is a substituted or unsubstituted $C_1$-$C_6$ alkylene or substituted or unsubstituted 2 to 6 membered heteroalkylene. In embodiments, $L^4$ is a substituted or unsubstituted methylene. In embodiments, $L^4$ is substituted with a substituted or unsubstituted $C_1$-$C_6$ alkylene. In embodiments, $L^4$ is an unsubstituted methylene.

In embodiments, $R^4$ is substituted or unsubstituted $C_1$-$C_6$ alkyl, substituted or unsubstituted 2 to 6 membered heteroalkyl, substituted or unsubstituted $C_3$-$C_6$ cycloalkyl, substituted or unsubstituted 3 to 6 membered heterocycloalkyl, substituted or unsubstituted phenyl, or substituted or unsubstituted 5 to 6 membered heteroaryl. In embodiments, $R^4$ is substituted or unsubstituted $C_1$-$C_6$ alkyl, or substituted or unsubstituted phenyl. In embodiments, $R^4$ is an unsubstituted $C_1$-$C_6$ alkyl.

In embodiments, $R^4$ is substituted (e.g., substituted with a substituent group, a size-limited substituent group, or lower substituent group) or unsubstituted alkyl. In embodiments, $R^4$ is substituted (e.g., substituted with a substituent group, a size-limited substituent group, or lower substituent group) alkyl. In embodiments, $R^4$ is unsubstituted alkyl. In embodiments, $R^4$ is substituted or unsubstituted alkyl (e.g., $C_1$-$C_8$, $C_1$-$C_6$, $C_1$-$C_4$, or $C_1$-$C_2$). In embodiments, $R^4$ is substituted alkyl (e.g., $C_1$-$C_8$, $C_1$-$C_6$, $C_1$-$C_4$, or $C_1$-$C_2$). In embodiments, $R^4$ is unsubstituted alkyl (e.g., $C_1$-$C_8$, $C_1$-$C_6$, $C_1$-$C_4$, or $C_1$-$C_2$).

In embodiments, $R^4$ is substituted (e.g., substituted with a substituent group, a size-limited substituent group, or lower substituent group) or unsubstituted heteroalkyl. In embodiments, $R^4$ is substituted (e.g., substituted with a substituent group, a size-limited substituent group, or lower substituent group) heteroalkyl. In embodiments, $R^4$ is unsubstituted heteroalkyl. In embodiments, $R^4$ is substituted or unsubstituted heteroalkyl (e.g., 2 to 8 membered, 2 to 6 membered, 4 to 6 membered, 2 to 3 membered, or 4 to 5 membered). In embodiments, $R^4$ is substituted heteroalkyl (e.g., 2 to 8 membered, 2 to 6 membered, 4 to 6 membered, 2 to 3 membered, or 4 to 5 membered). In embodiments, $R^4$ is an unsubstituted heteroalkyl (e.g., 2 to 8 membered, 2 to 6 membered, 4 to 6 membered, 2 to 3 membered, or 4 to 5 membered).

In embodiments, $R^4$ is substituted or unsubstituted alkyl (e.g., $C_1$-$C_8$ alkyl, $C_1$-$C_6$ alkyl, or $C_1$-$C_4$ alkyl). In embodiments, $R^4$ is substituted alkyl (e.g., $C_1$-$C_8$ alkyl, $C_1$-$C_6$ alkyl, or $C_1$-$C_4$ alkyl). In embodiments, $R^4$ is an unsubstituted alkyl (e.g., $C_1$-$C_8$ alkyl, $C_1$-$C_6$ alkyl, or $C_1$-$C_4$ alkyl). In embodiments, $R^4$ is substituted or unsubstituted methyl. In embodiments, $R^4$ is substituted or unsubstituted $C_2$ alkyl. In embodiments, $R^4$ is substituted or unsubstituted $C_3$ alkyl. In embodiments, $R^4$ is substituted or unsubstituted $C_4$ alkyl. In embodiments, $R^4$ is substituted or unsubstituted alkyl. In embodiments, $R^4$ is substituted or unsubstituted $C_6$ alkyl. In embodiments, $R^4$ is substituted or unsubstituted $C_7$ alkyl. In embodiments, $R^4$ is substituted or unsubstituted $C_8$ alkyl. In embodiments, $R^4$ is substituted methyl. In embodiments, $R^4$ is substituted $C_2$ alkyl. In embodiments, $R^4$ is substituted $C_3$ alkyl. In embodiments, $R^4$ is substituted $C_4$ alkyl. In embodiments, $R^4$ is substituted $C_5$ alkyl. In embodiments, $R^4$ is substituted $C_6$ alkyl. In embodiments, $R^4$ is substituted $C_7$ alkyl. In embodiments, $R^4$ is substituted $C_8$ alkyl. In embodiments, $R^4$ is an unsubstituted methyl. In embodiments, $R^4$ is an unsubstituted $C_2$ alkyl. In embodiments, $R^4$ is an unsubstituted $C_3$ alkyl. In embodiments, $R^4$ is an unsubstituted $C_4$ alkyl (e.g., t-butyl). In embodiments, $R^4$ is an unsubstituted $C_5$ alkyl. In embodiments, $R^4$ is an unsubstituted $C_6$ alkyl. In embodiments, $R^4$ is an unsubstituted $C_7$ alkyl. In embodiments, $R^4$ is an unsubstituted $C_8$ alkyl.

In embodiments, the nucleotide analogue has the formula:

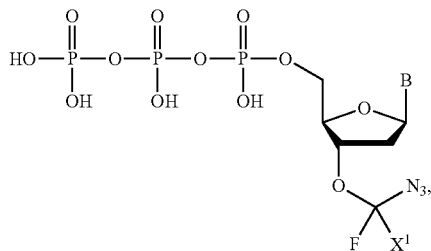

wherein B and $X^1$ are as described herein, including embodiments. In embodiments, the nucleotide analogue has the formula:

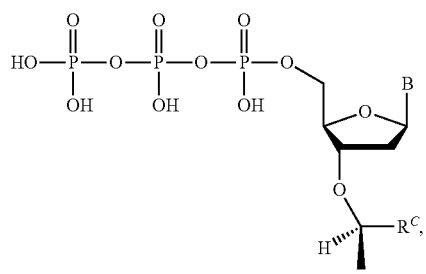

wherein B and $R^C$ are as described herein, including embodiments. In embodiments, the nucleotide analogue has the formula:

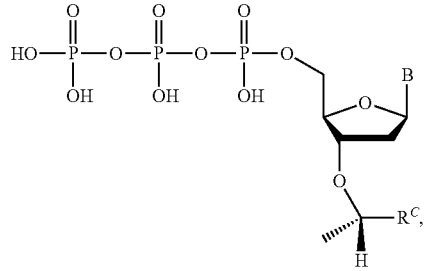

wherein B and $R^C$ are as described herein, including embodiments. In embodiments, the nucleotide analogue has the formula:

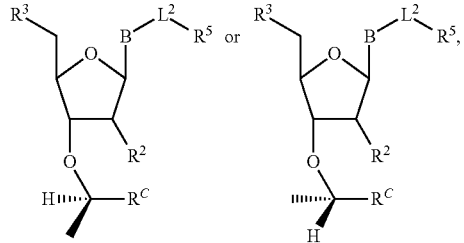

wherein $R^2$, $R^3$, B, $L^2$, $L^5$, and $R^C$ are as described herein.

In embodiments, the nucleotide analogue has the formula:

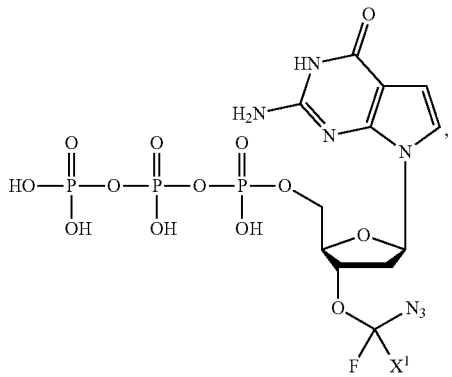

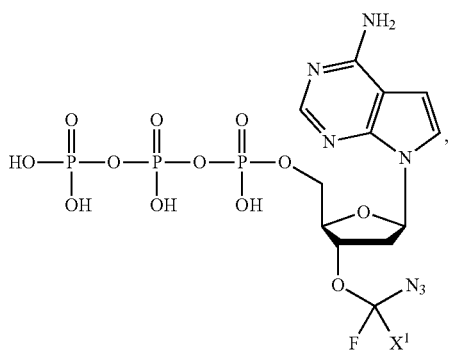

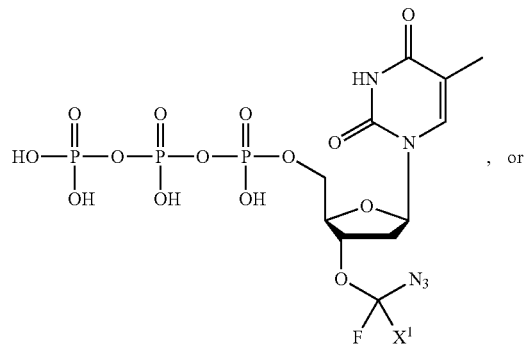

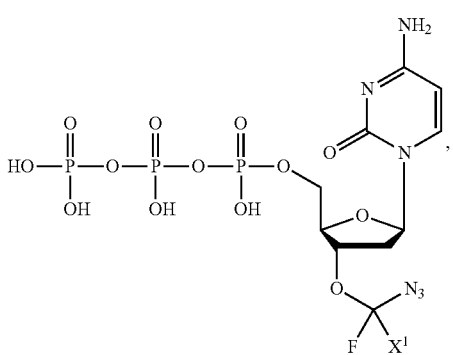

wherein $X^1$ is as described herein, including embodiments.

In embodiments, the nucleotide analogue has the formula:

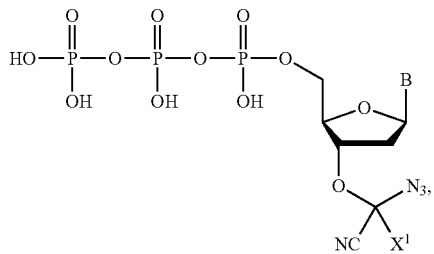

wherein B and $X^1$ are as described herein, including embodiments.

In embodiments, the nucleotide analogue has the formula:

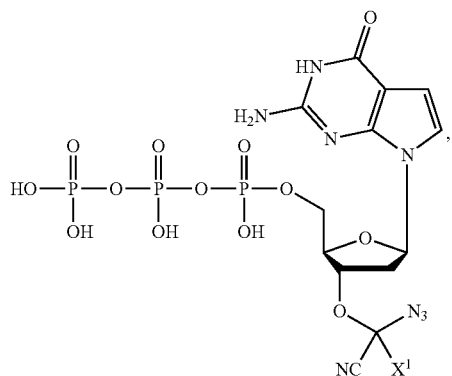

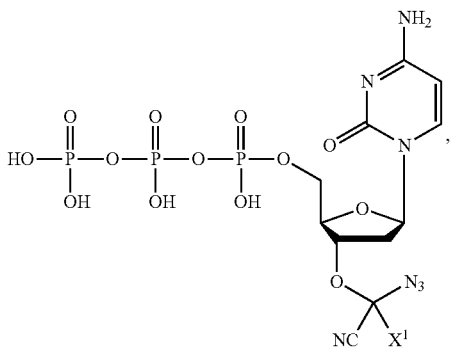

wherein $X^1$ is as described herein, including embodiments.

In embodiments, the nucleotide analogue has the formula:

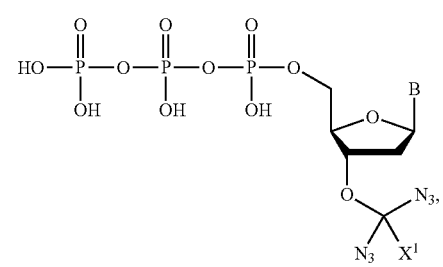

wherein B and $X^1$ are as described herein, including embodiments.

In embodiments, the nucleotide analogue has the formula:

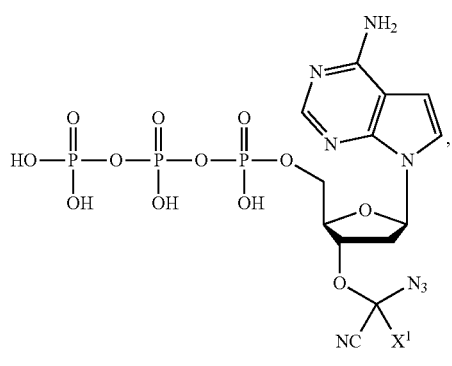

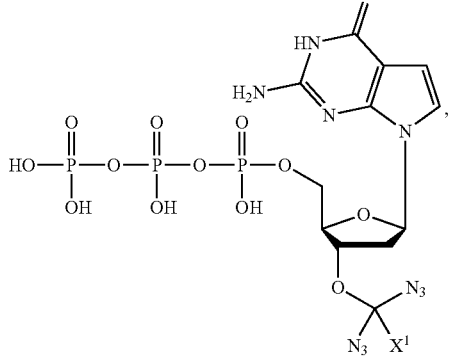

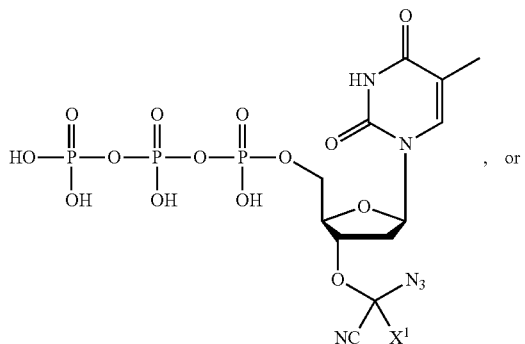, or

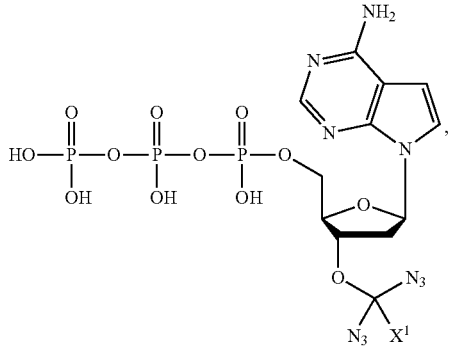

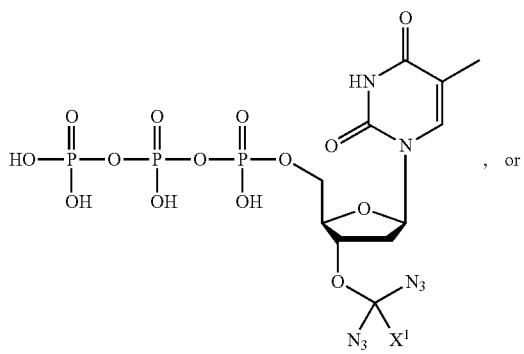
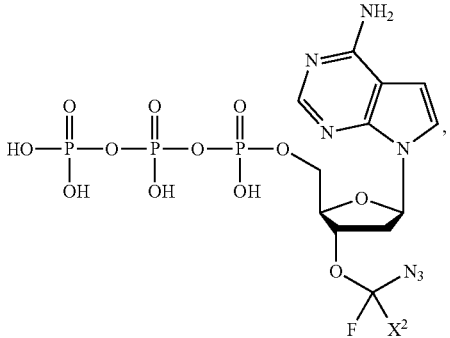
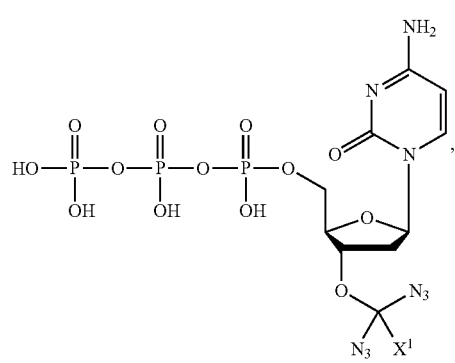
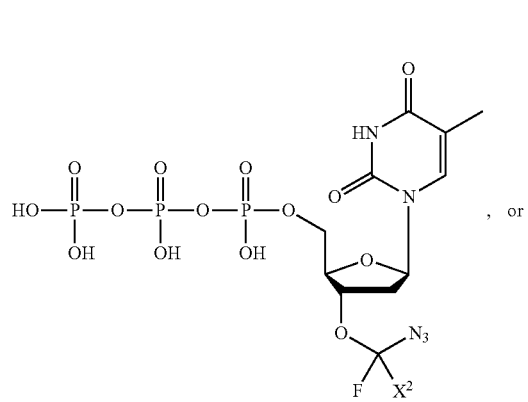
wherein $X^1$ is as described herein, including embodiments.
In embodiments, the nucleotide analogue has the formula:
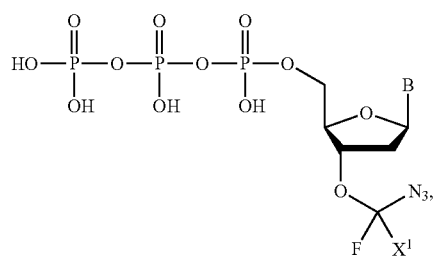
wherein B and $X^2$ are as described herein, including embodiments.
In embodiments, the nucleotide analogue has the formula:
wherein $X^2$ is as described herein, including embodiments.
In embodiments, the nucleotide analogue has the formula:
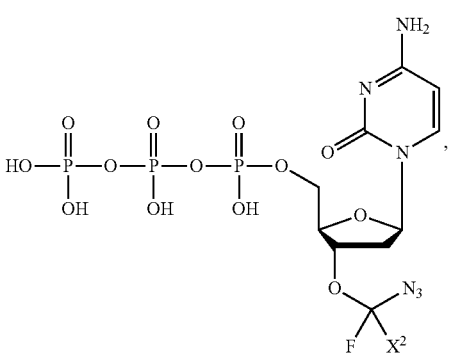
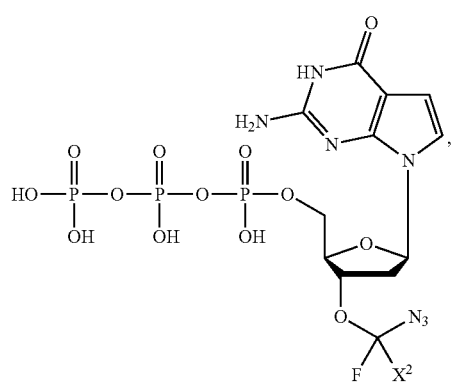
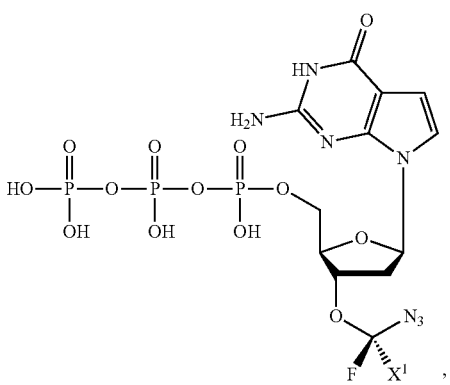

-continued

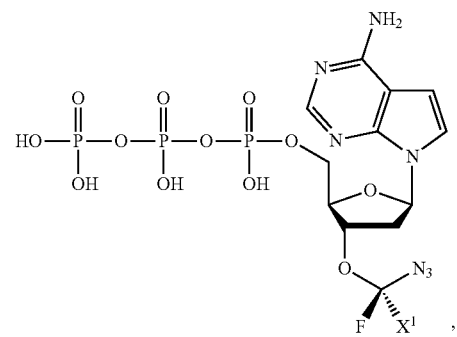

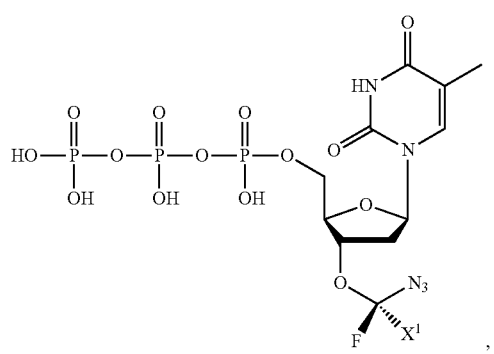

, or

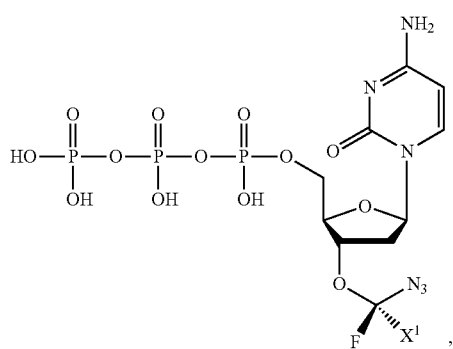

wherein $X^1$ is as described herein, including embodiments.

In embodiments, the nucleotide analogue has the formula:

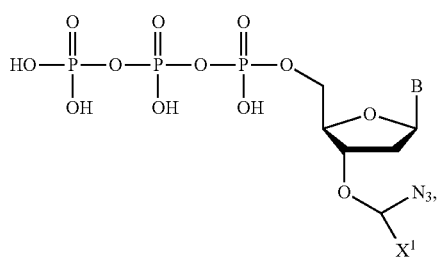

wherein B and $X^1$ are as described herein, including embodiments.

In embodiments, the nucleotide analogue has the formula:

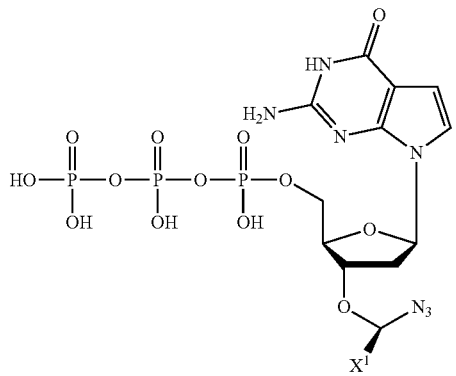

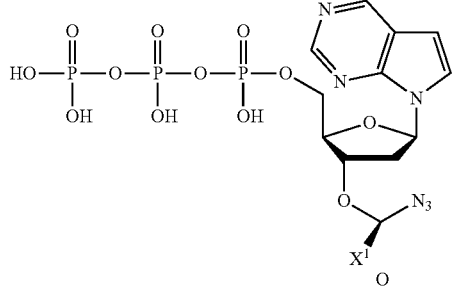

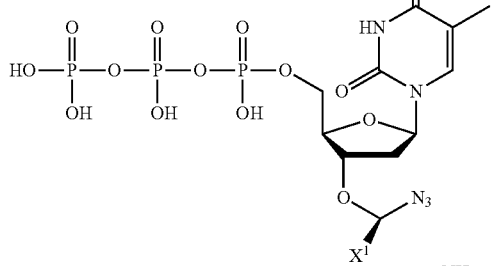

, or

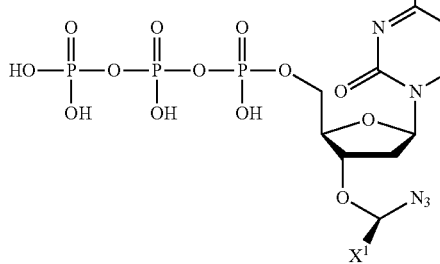

wherein $X^1$ is as described herein, including embodiments.

In embodiments, the nucleotide analogue has the formula:

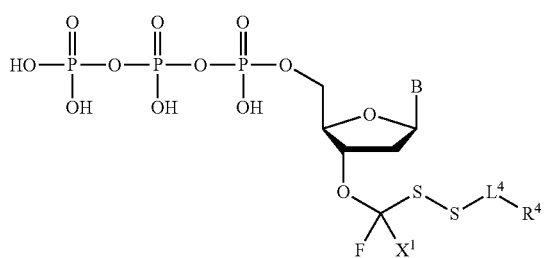

wherein $X^1$, B, $L^4$, and $R^4$ are as described herein, including embodiments.

In embodiments, the nucleotide analogue has the formula:

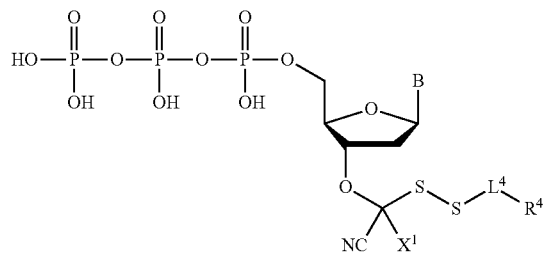

wherein $X^1$, B, $L^4$, and $R^4$ are as described herein, including embodiments.

In embodiments, the nucleotide analogue has the formula:

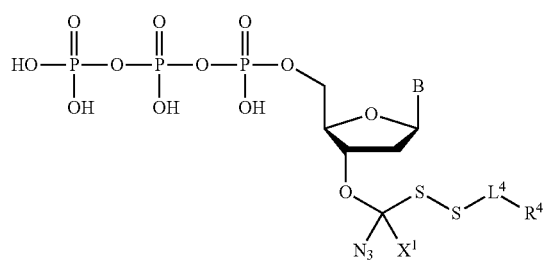

wherein $X^1$, B, $L^4$, and $R^4$ are as described herein, including embodiments.

In embodiments, the nucleotide analogue has the formula:

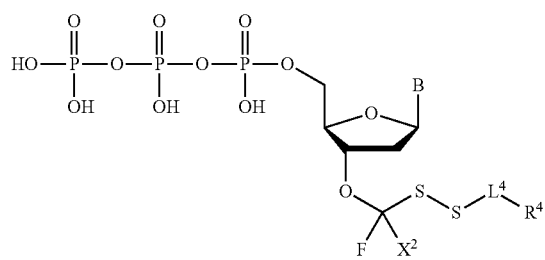

wherein $X^2$, B, $L^4$, and $R^4$ are as described herein, including embodiments.

In embodiments, the nucleotide analogue has the formula:

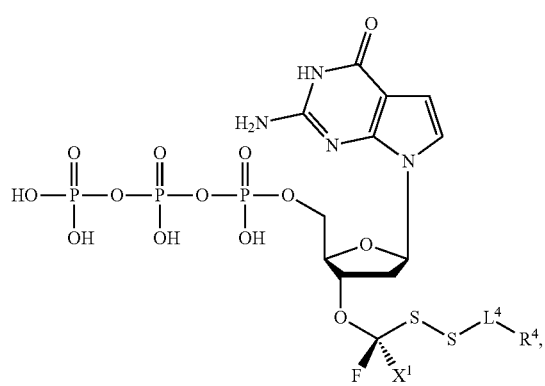

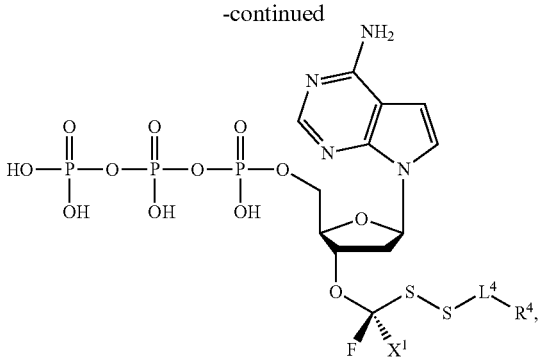

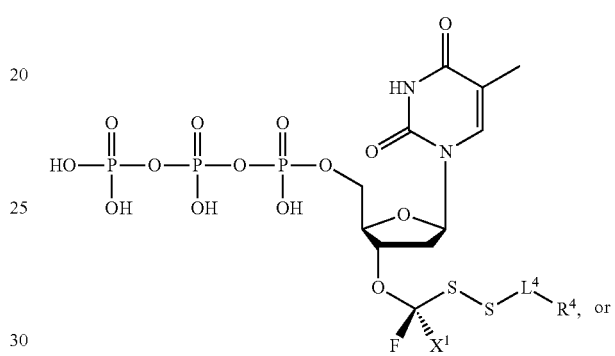

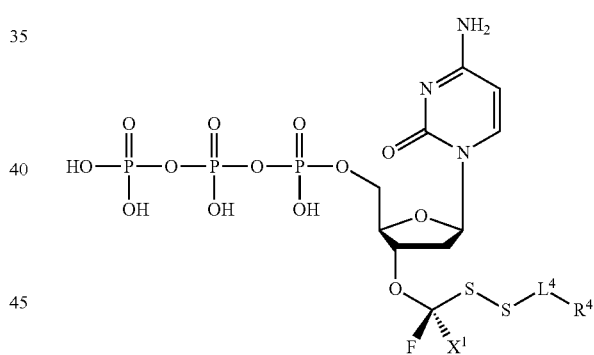

wherein $X^1$, $L^4$, and $R^4$ are as described herein, including embodiments.

In embodiments, the nucleotide analogue has the formula:

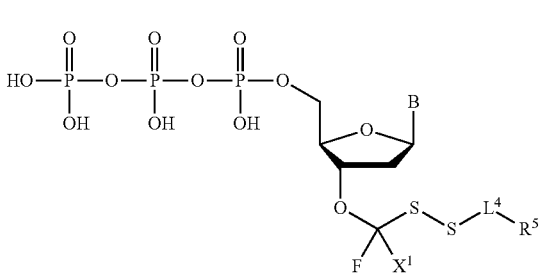

wherein $X^1$, B, $L^4$, and $R^5$ are as described herein, including embodiments.

133

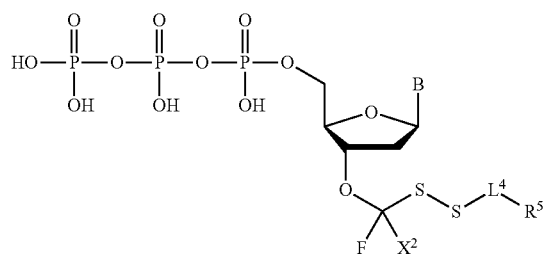

wherein $X^2$, B, $L^4$, and $R^5$ are as described herein, including embodiments.

In embodiments, the nucleotide analogue has the formula:

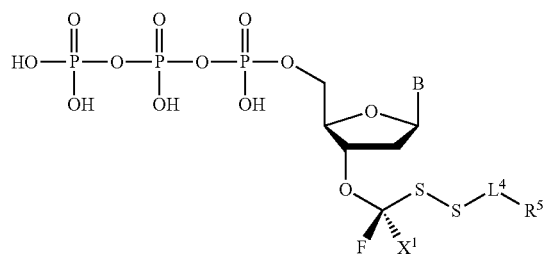

wherein $X^1$, B, $L^4$, and $R^5$ are as described herein, including embodiments.

In embodiments, the nucleotide analogue has the formula:

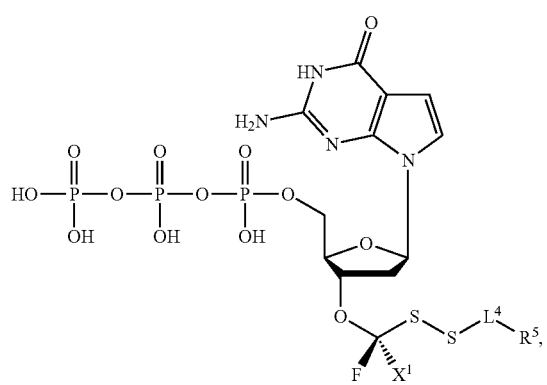

134

-continued

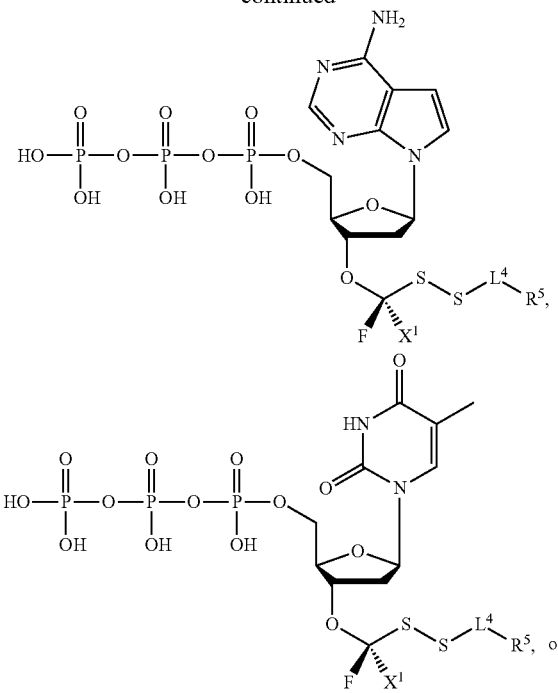

wherein $X^1$, $L^4$, and $R^5$ are as described herein, including embodiments.

In embodiments, the nucleotide analogue has the formula:

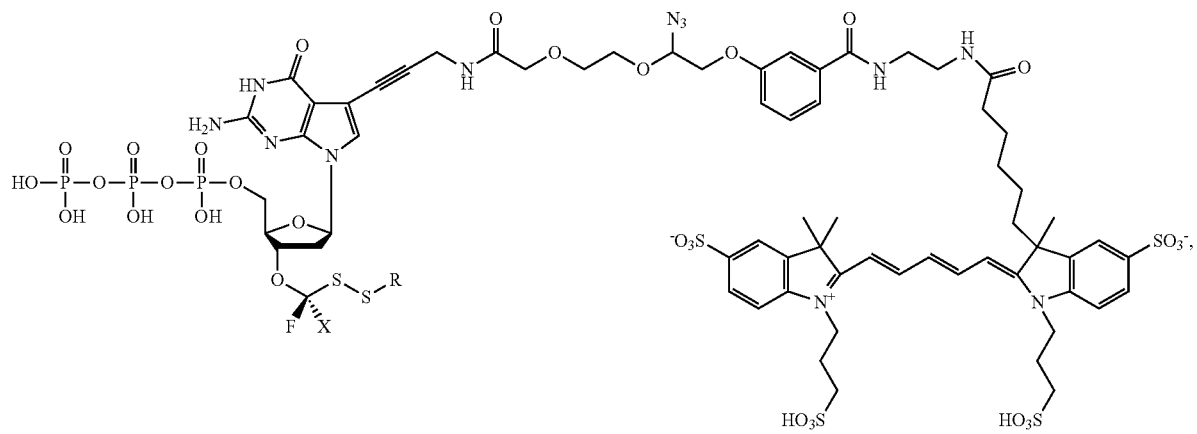

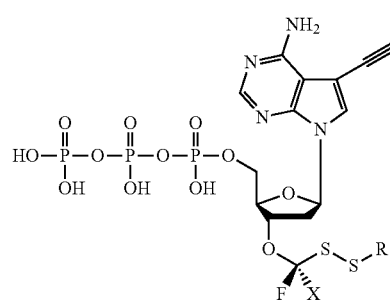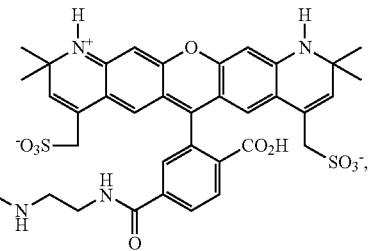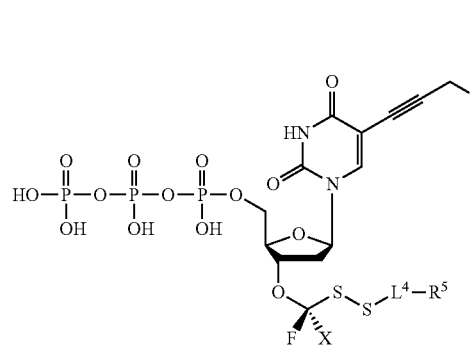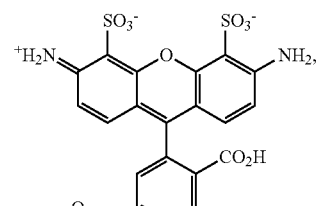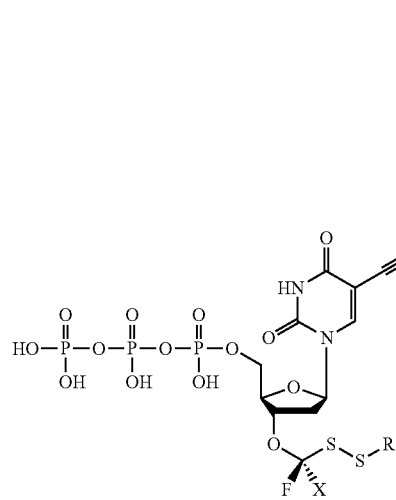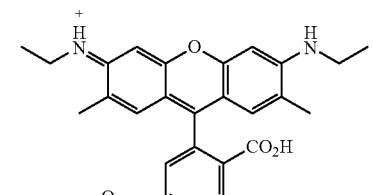

-continued
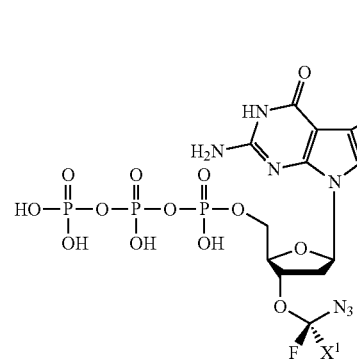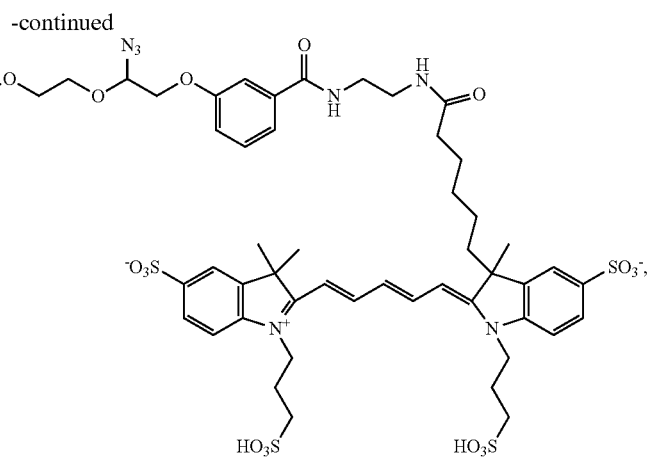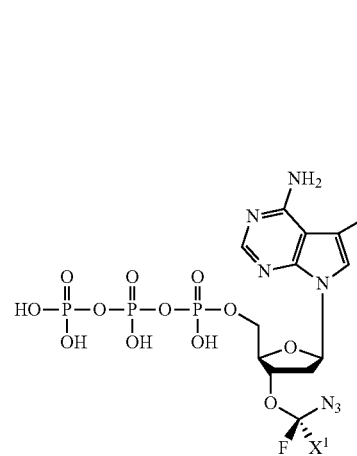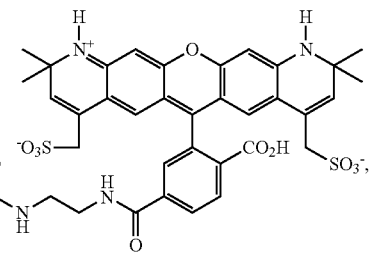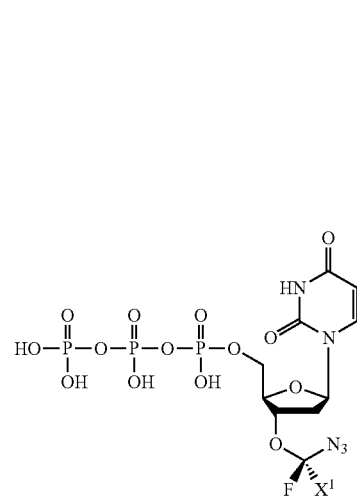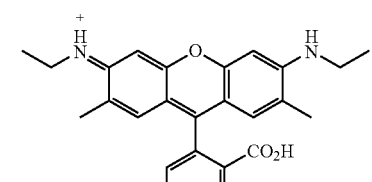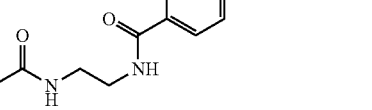

-continued
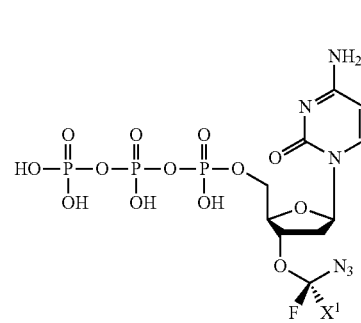
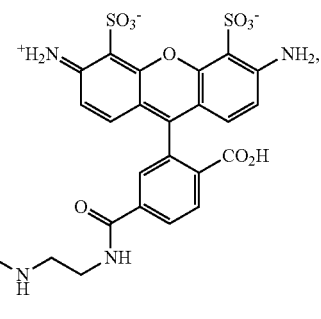
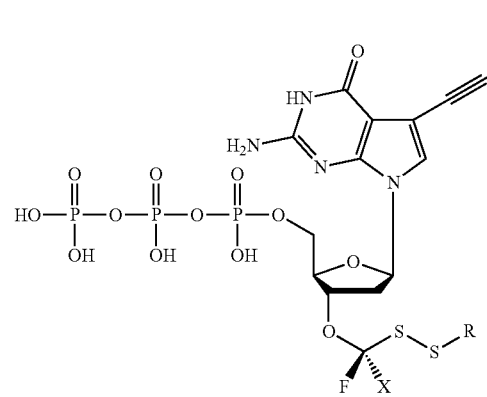
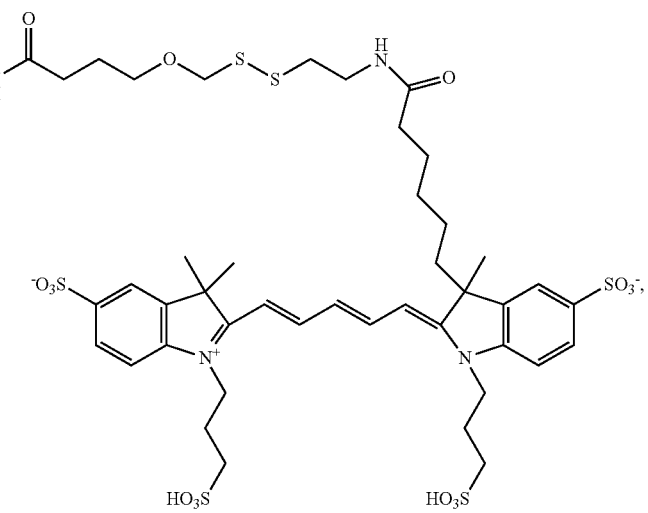
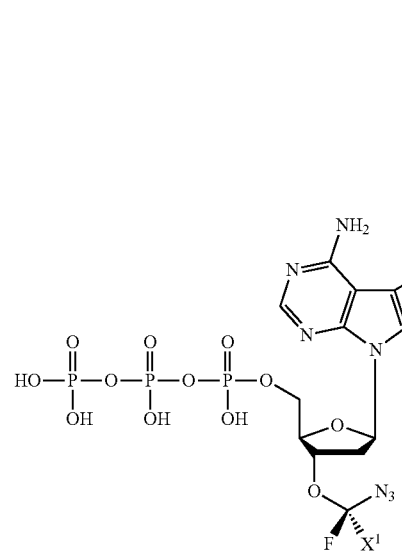

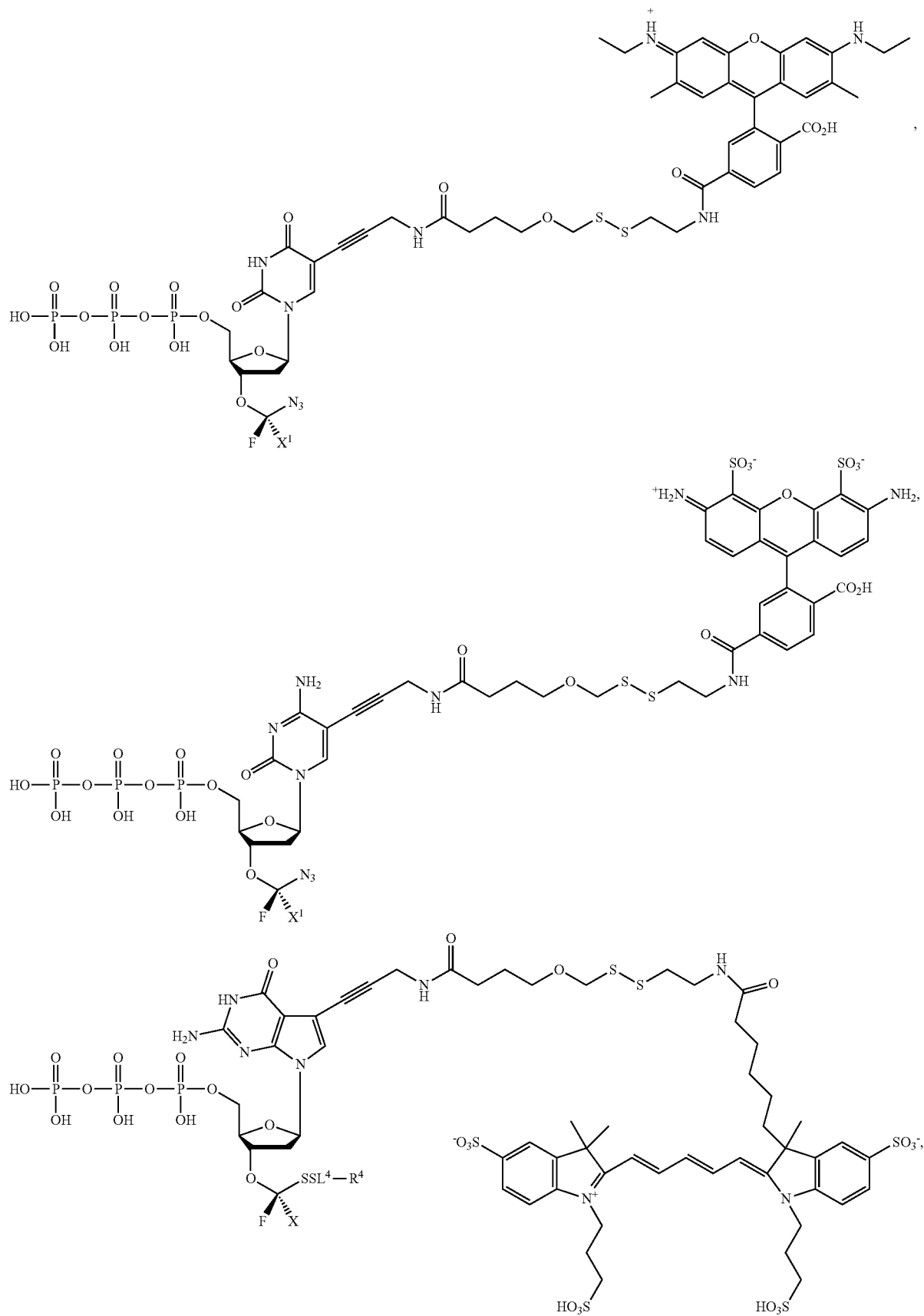

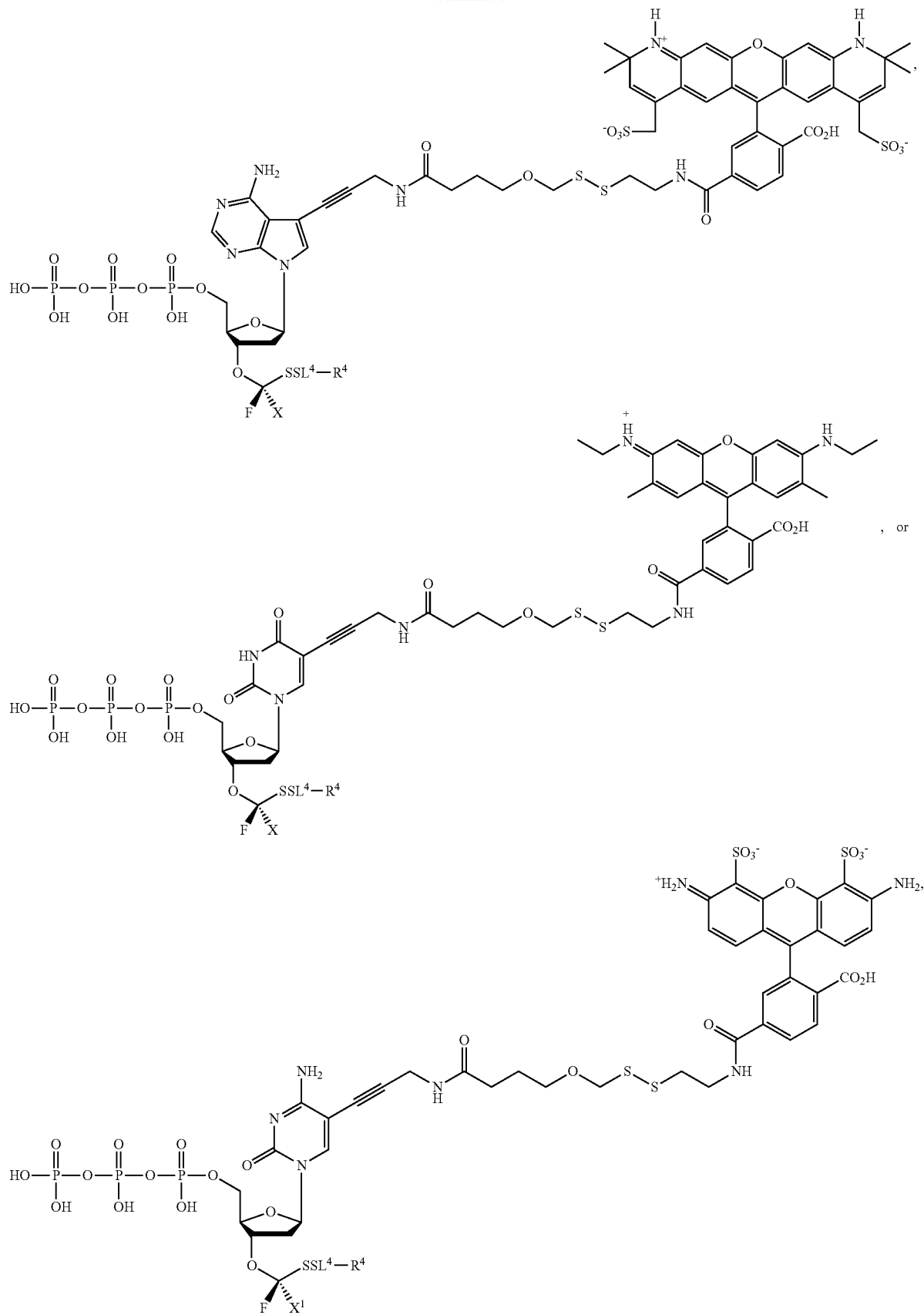

wherein X and X¹ are each independently a halogen, and L⁴, and R⁴ are as described herein.

In embodiments, the polymerases provided herein are used with modified nucleotides and nucleic acid synthesis methods as described in US 2018/0274024, WO/2017/058953, WO 2017/205336, or US 2019/0077726, the contents of which are incorporated by reference herein for all purposes.

In embodiments, methods of incorporating a modified nucleotide into a nucleic acid sequence provided herein includes a polymerase (a synthetic or variant DNA polymerase) with one or more amino acid substitution mutations at position 129, 141, 143, 409, 410, 411 and/or 486. In embodiments, the polymerase includes an amino acid substitution at position 141. The amino acid substitution at position 141 may be an alanine substitution, a glycine substitution, a valine substitution, a methionine substitution, a leucine substitution or an isoleucine substitution. In embodiments, the amino acid substitution at position 141 is an alanine substitution. In embodiments, the polymerase includes an amino acid substitution at position 143. The amino acid substitution at position 143 may be an alanine substitution, a glycine substitution, a valine substitution, a methionine substitution, a leucine substitution or an isoleucine substitution. In embodiments, the amino acid substitution at position 143 is an alanine substitution.

In embodiments, the polymerase includes an amino acid substitution at position 129. The amino acid substitution at position 129 may be an alanine substitution, a glycine substitution, a valine substitution, a leucine substitution or an isoleucine substitution. In embodiments, the amino acid substitution at position 129 is an alanine substitution.

In embodiments, the polymerase includes an amino acid substitution at position 409. The amino acid substitution at position 409 may be a serine substitution or a threonine substitution. In embodiments, the amino acid substitution at position 409 is a serine substitution. In embodiments, the amino acid substitution at position 409 is an alanine substitution, a glycine substitution, a valine substitution, a leucine substitution or an isoleucine substitution. In embodiments, the amino acid substitution at position 409 is an alanine substitution, a glycine substitution, a valine substitution, a leucine substitution or an isoleucine substitution.

In embodiments, the polymerase includes an amino acid substitution at position 410. The amino acid substitution at position 410 may be an alanine substitution, a glycine substitution, a valine substitution, a methionine substitution, a leucine substitution or an isoleucine substitution. In embodiments, the amino acid substitution at position 410 is an alanine substitution.

In embodiments, the polymerase includes an amino acid substitution at position 411. The amino acid substitution at position 411 may be an alanine substitution, a glycine substitution, a valine substitution, a leucine substitution or an isoleucine substitution. In embodiments, the amino acid substitution at position 411 is a valine substitution, a leucine substitution or an isoleucine substitution. In embodiments, the amino acid substitution at position 411 is a valine substitution or an isoleucine substitution. In embodiments, the amino acid substitution at position 411 is a valine substitution. In embodiments, the amino acid substitution at position 411 is an isoleucine substitution.

In embodiments, the polymerase includes an amino acid substitution at position 486. The amino acid substitution at position 486 may be an alanine substitution, a glycine substitution, a valine substitution, a leucine substitution or an isoleucine substitution. In embodiments, the amino acid substitution at position 486 is a valine substitution.

In embodiments, the polymerase includes an amino acid sequence that is at least 80% identical to a continuous 500 amino acid sequence within SEQ ID NO: 1. The polymerase includes substitution mutations at positions 141 and 143 of SEQ ID NO: 1. The polymerase further includes at least one amino acid substitution mutation at a position selected from positions 129, 409, 410, 411 and/or 486 of SEQ ID NO: 1.

In embodiments, the polymerase includes an amino acid sequence that is at least 85%, at least 90%, or at least 95% identical to a continuous 500 amino acid sequence within SEQ ID NO: 1. In embodiments, the polymerase includes an amino acid sequence that is at least 80%, at least 85%, at least 90%, or at least 95% identical to a continuous 600 amino acid sequence within SEQ ID NO: 1. In embodiments, the polymerase includes an amino acid sequence that is at least 80%, at least 85%, at least 90%, or at least 95% identical to a continuous 700 amino acid sequence within SEQ ID NO: 1.

In embodiments, the polymerase includes alanine substitution mutations at positions 141 and 143 of SEQ ID NO: 1. In embodiments, the polymerase further includes at least one amino acid substitution mutation at a position selected from positions 129, 409, 410, 411 and/or 486 of SEQ ID NO: 1. In embodiments, the polymerase further includes at least one amino acid substitution at a position selected from an alanine, glycine, leucine, isoleucine, or valine at position 129, a serine, threonine, an asparagine, a glutamine, an alanine, a glycine, an isoleucine, a valine, or a methionine at position 409, an alanine, a glycine, an isoleucine, a valine, or a methionine at position 410, a valine, isoleucine, leucine, or methionine at position 411, and a valine, isoleucine, leucine, or methionine at position 486. In embodiments, the polymerase further includes one amino acid substitution mutation selected from a serine at position 409, an alanine at position 410, a valine at position 411, and a valine at position 486. In embodiments, the polymerase further includes one amino acid substitution mutation selected from an alanine at position 129, a serine at position 409, an alanine at position 410, an isoleucine at position 411, and a valine at position 486.

In embodiments, the polymerase includes alanine substitution mutations at positions 141 and 143 of SEQ ID NO: 1 and further includes a serine at position 409, an alanine at position 410, and a valine at position 411 as exemplified by SEQ ID NO: 71. In embodiments, the polymerase includes alanine substitution mutations at positions 141 and 143, of SEQ ID NO: 1 and further includes a serine at position 409, an alanine at position 410, a valine at position 411 and a valine at position 486 as exemplified by SEQ ID NO: 72. In embodiments, the polymerase includes alanine substitution mutations at positions 141 and 143 of SEQ ID NO: 1 and further includes an alanine at position 129, an alanine at position 409, an alanine at position 410, an isoleucine at position 411 and a valine at position 486 as exemplified by SEQ ID NO: 3.

The polymerase (a synthetic or variant DNA polymerase) may have a sequence that is at least 60%, at least 65%, at least 70%, at least 75%, at least 80%, at least 85%, at least 90%, or at least 95% identical to the wild-type sequence of *P. abyssi* family B DNA polymerase of SEQ ID NO: 1. In embodiments, the polymerase (a synthetic or variant DNA polymerase) may have a sequence that is 60%, 61%, 62%, 63%, 64%, 65%, 66%, 67%, 68%, or 69% identical to the wild-type sequence of *P. abyssi* family B DNA polymerase of SEQ ID NO: 1. The polymerase (a synthetic or variant DNA polymerase) may have a sequence that is 70%, 71%, 72%, 73%, 74%, 75%, 76%, 77%, 78%, or 79% identical to the wild-type sequence of *P. abyssi* family B DNA polymerase of SEQ ID NO: 1. The polymerase (a synthetic or variant DNA polymerase) may have a sequence that is 80%, 81%, 82%, 83%, 84%, 85%, 86%, 87%, 88%, or 89% identical to the wild-type sequence of *P. abyssi* family B DNA polymerase of SEQ ID NO: 1. The polymerase (a synthetic or variant DNA polymerase) may have a sequence that is 90%, 91%, 92%, 93%, 94%, 95%, 96%, 97%, 98%, or 99% identical to the wild-type sequence of *P. abyssi* family B DNA polymerase of SEQ ID NO: 1.

The polymerase (a synthetic or variant DNA polymerase) may have a sequence that is identical to a continuous 500, 600, or 700 continuous amino acids of SEQ ID NO: 1. In embodiments, the polymerase (a synthetic or variant DNA polymerase) may have a sequence that is identical to a continuous 500, 505, 510, 515, 520, 525, 530, 535, 540, 545, 550, 555, 560, 565, 570, 575, 580, 585, 590, or 595 continuous amino acids of SEQ ID NO: 1. In embodiments, the polymerase (a synthetic or variant DNA polymerase) may have a sequence that is identical to a continuous 600, 605, 610, 615, 620, 625, 630, 635, 640, 645, 650, 655, 660, 665, 670, 675, 680, 685, 690, or 695 continuous amino acids of SEQ ID NO: 1.

Examples of mutations giving rise to an exo⁻/exo⁻ variants include mutations at positions in a parent polymerase corresponding to positions in SEQ ID NO: 1 identified as follows: 141, 143, 215, and 315.

In embodiments, mutations may include substitution of the amino acid in the parent amino acid sequences with an amino acid, which is not the parent amino acid. In embodiments, the mutations may result in conservative amino acid changes. In embodiments, non-polar amino acids may be converted into polar amino acids (threonine, asparagine, glutamine, cysteine, tyrosine, aspartic acid, glutamic acid or histidine) or the parent amino acid may be changed to an alanine.

In embodiments, the method includes maintaining the temperature at about 55° C. In embodiments, the method includes maintaining the temperature at about 55° C. to about 80° C. In embodiments, the method includes maintaining the temperature at about 60° C. to about 70° C. In embodiments, the method includes maintaining the temperature at about 65° C. to about 75° C. In embodiments, the method includes maintaining the temperature at about 65° C. In embodiments, the method includes maintaining the temperature at a pH of 8.0 to 11.0. In embodiments, the pH is 9.0 to 11.0. In embodiments, the pH is 9.5. In embodiments, the pH is 10.0. In embodiments, the pH is 8.0, 8.5, 9.0, 9.5, 10.0, 10.5, or 11.0. In embodiments, the pH is from 9.0 to 11.0, and the temperature is about 60° C. to about 70° C.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

EXAMPLES

Example 1: Development of Family B DNA Polymerase Variants

A number of Family B polymerases from Archaea that have sequences with a range of 30-80% identity to *Ther-mococcus* sp. 9° N amino acid sequence (SEQ ID NO: 209) were selected. One from *Pyrococcus abyssi* (as denoted in SEQ ID NO: 1 which has 80% identity to SEQ ID NO: 209) and a second from *Pyrobaculum calidifontis* JCM 11548 (as denoted in SEQ ID NO: 210 which has 35% identity to SEQ ID NO: 209) were chosen for evaluation. Expression constructs for these sequences, which correspond to wild type or parent polymerase were made and expressed in *E. coli*. The expressed protein (polymerase) were purified from *E. coli* and tested for polymerase and exonuclease activity. For *Pyrobaculum calidifontis* JCM 11548, the purified polymerase exhibited less than 5% specific activity for both DNA polymerase and exonuclease activity compared with *Thermococcus* sp. 9° N. Due to the low activity, this polymerase was not analyzed further.

All polymerases used were expressed in *E. coli* BL21 STAR (DE3) (ThermoFisher) as follows. First, the gene was synthesized (ATUM) in pD451-SR expression vector using codons selected for high-yield expression. Whenever needed, additional in vitro substitution mutagenesis was performed on the gene sequence using a Site Directed Mutagenesis Kit (New England Biolabs) and confirmed by Sanger sequencing.

Clones for each variant were transformed into BL21 STAR (DE3) (ThermoFisher) and incubated at 37° C. with shaking in 2.0 L flasks until an $OD_{600}$ of 0.6 was reached. Then IPTG (1 mM final concentration) was added to induce specific protein expression. The cells were incubated 3 hours at 37° C. and collected by centrifugation at 5000 rpm for 5 minutes. Cell pellets were stored at minus 80° C.

All purification steps were performed at 4° C. except as indicated. The frozen cell paste was resuspended in lysis buffer (20 mM Tris pH 7.5, 500 mM NaCl, 1 mM EDTA, 1 mM DTT, 10% Glycerol, 1 mM PMSF, and protease inhibitor cocktail, EDTA-free (Thermo Fisher). The suspended cells were subjected to sonication and centrifuged at 20,000 rpm for 20 min. Then the supernatant was heated to 80° C. for 30 min to inactivate host proteins. The mixture was again centrifuged at 20,000 rpm for 20 min and the pellet discarded.

The supernatant was collected and Poly(ethyleneimine) was added slowly to the supernatant to a final concentration of 0.4% with continued stirring for 30 minutes. The mixture was centrifuged at 20,000 rpm for 20 min and the pellet was discarded. Then solid ammonium sulfate was added to the supernatant to 65% saturation with stirring continued for 30 min. The mixture was centrifuged at 20,000 rpm for 20 min and the precipitated proteins were resuspended in 10 ml Buffer A (20 mM Tris pH 7.0, 50 mM KCl, 0.1 mM EDTA, 10% glycerol, 1 mM DTT, 1 mM PMSF). The protein was dialyzed overnight against 1 Liter Buffer A. The dialyzed sample was centrifuged at 20,000 rpm for 20 min to remove any precipitate and the supernatant was loaded onto a 5 ml Hi-Trap SP FF column (GE Healthcare) equilibrated with Buffer A. The polymerase was eluted using a 100 ml gradient from 50 to 800 mM KCl. Peak fractions were pooled and dialyzed overnight against Buffer B (20 mM Tris pH 7.5, 50 mM KCl, 0.1 mM EDTA, 10% glycerol, 1 mM DTT, 1 mM PMSF). The dialyzed sample was centrifuged at 20,000 rpm for 20 min to remove any precipitate and the supernatant was loaded onto a 5 ml Hi-Trap Heparin column (GE Healthcare) equilibrated with Buffer B. The polymerase was eluted using a 100 ml gradient from 50 to 800 mM KCl. Peak fractions were pooled and dialyzed overnight against storage buffer (20 mM Tris pH 7.5, 100 mM KCl, 0.1 mM EDTA, 50% glycerol, 1 mM DTT) and stored at −20° C.

Polymerase and exonuclease assays were done using a fluorescent primer/template as described (Nikiforov 2014; Nikiforov T T. 2011).

*Pyrococcus abyssi* wildtype polymerase showed both polymerase and exonuclease activity. Variants were constructed and tested for polymerase, exonuclease and for activity with nucleotide reversible terminators and for sequencing SBS. Variant SG1100 includes alanine at position 141 and 143, a serine at position 409, an alanine at position 410, and a valine at position 411. Variant SG1105 includes alanine at position 141 and 143, a serine at position 409, an alanine at position 410, a valine at position 411 and a valine at position 486. SG1200 includes alanine at position 129, 141, 143, 409, and 410, an isoleucine at position 411 and a valine at position 486. The full plasmid nucleic acid sequence used to generate *P. abyssi* protein SG1200 is provided in SEQ ID NO: 215.

The aim of the general experimental plan was to produce an optimized polymerase for nucleic acid sequencing methods. A total of 488 variants of *P. abyssi* were engineered. All variants were profiled against a variety of reverse terminators. Some of the better performing enzymes have between 7 and 12 mutations relative to the wild-type. Included herein are 202 sequences of the *P. abyssi* based enzymes that appear useful for nucleic acid sequencing. The motif A region having mutations SAP, SAV, SGI, AGP, and AGI are among the better performing enzymes in terms of incorporation rate.

Example 2: Assay for Incorporation of Nucleotide Reversible Terminators

The rate of incorporation of a fluorescent NRT was measured using primer/templates attached to avidin-coated magnetic beads (MyOne C1, ThermoFisher). The 5'-biotinylated 160 primer is annealed to the appropriate 160-X template and bound to the beads along with a tethering oligo 5'-Biotin-CG(TAGCCG)$_6$TAGC-ddC (tether B). The beads are then attached to the surface of 384-well streptavidin-coated plates (Greiner Bio-one) to which tether A (5'-Biotin-GC(TACGGC)$_6$TACG-ddC) has previously been bound. Reactions are initiated in a buffer (e.g., Thermopol buffer (New England Biolabs)) by the addition of 200 nM NRT and 133 nM DNA polymerase at a temperature of 60° C. The reaction is stopped by flooding duplicate wells with room temperature wash buffer (1 mM EDTA, 20 mM Tris pH 8, 50 mM NaCl, 0.025% Triton X-100) after incubation for 30 sec and additional wells after 10 min. Blanks were also made without incubation. The wells were imaged under a fluorescence microscope, and the images analyzed using software that identifies fluorescent beads and calculates their average brightness. The blank was subtracted from the time points and the values at 30 sec and 10 min used to calculate the half-time of incorporation assuming first-order kinetics with completion in under 10 min.

TABLE 2

| | Template Sequences |
|---|---|
| 160-1 (SEQ ID NO: 204) | 5'-GACTCACATGAATCAGTGCAGCATCAGATGTATGA<u>C</u>CGAAGCGGACGAAGGTGCGTGGA-ddC |
| 160-2 (SEQ ID NO: 205) | 5'-GTGGTTCATCGCGTCCGATATCAAACTTCGTCAAG<u>T</u>CGAAGCGGACGAAGGTGCGTGGA-ddC |
| 160-3 (SEQ ID NO: 206) | 5'-TACTAGGTTGTACGATCCCTGCACTTCAGCTAAGC<u>A</u>CGAAGCGGACGAAGGTGCGTGGA-ddC |
| 160-4 (SEQ ID NO: 207) | 5'-AGCTACCAATATTTAGTTTCCGAGTCTCAGCTCAT<u>G</u>CGAAGCGGACGAAGGTGCGTGGA-ddC |
| 160 Primer (SEQ ID NO: 208) | 5'-Biotin-AAAAAAAAAAAAGTCCACGCACCTTCGTCCGCTTCG |

The underlined nucleotide is the first one downstream from the 160 primer. The results as shown in Table 3 indicate that the new backbone polymerases from *P. abyssi* (SG1100, SG1105, SG1200) have activities with NRTs that are comparable to those of Terminator.

TABLE 3

| Initial Assay Results | | |
|---|---|---|
| | Half Time (sec) | |
| | S Term | A Term |
| SG1100 | 18 | 16 |
| SG1105 | 9 | 16 |
| SG1200 | 16 | 10 |
| Therm. IX | 20 | 17 |

Shown are average half-times for incorporation of NRTs by various polymerases. S-Term refers to sulfide-containing terminators (WO 2017/058953). A-Term refers to azide-containing terminators (Guo J, et al. PNAS 2008) Therminator IX (Therm. IX) is a polymerase from New England Biolabs.

Example 3: Isomer Differentiation

Balancing incorporation kinetics and fidelity is a challenge. If the mutations in the polymerase result in a rapid average incorporation half time but is too promiscuous such that the inappropriate nucleotide is incorporated into the primer, this will result in a large source of error in sequencing applications. It is also desirable to design a polymerase capable of incorporating a variety of reversible terminators. Through rational design of the motif A region, a series of mutations that accelerate incorporation with an acceptable fidelity score was discovered.

To explore the motif A region, three differently sized reversible terminator probes linked to the 3' oxygen were used: an A-Term, S-Term, and i-term. A-Term refers to azide-containing terminators (Guo J, et al. PNAS 2008); for example having the formula:

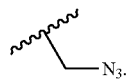

S-Term refers to sulfide-containing terminators (WO 2017/058953); for example having the formula

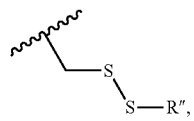

wherein R" is unsubstituted $C_1$-$C_4$ alkyl. The i-Term probe refers to an isomeric reversible terminator For example, an i-term probe has the formula:

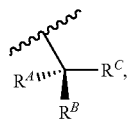

wherein $R^A$ and $R^B$ are hydrogen or alkyl, wherein at least one of $R^A$ or $R^B$ are hydrogen to yield a steroisomeric probe, and $R^C$ is the remainder of the reversible terminator.

Certain mutations in the polymerase favor the incorporation of one isomer, thus creating optimized polymerases for a unique class of reversible terminators.

In embodiments, the nucleotide is

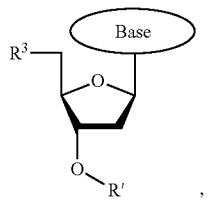

wherein Base is a Base as described herein, $R^3$ is —OH, monophosphate, or polyphosphate or a nucleic acid, and R' is a reversible terminator having the formula:

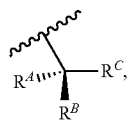

wherein $R^A$ and $R^B$ are hydrogen or alkyl and $R^C$ is the remainder of the reversible terminator. In embodiments, $R^A$ is methyl, $R^B$ is hydrogen, and $R^C$ is the remainder of the reversible terminator moiety. In embodiments, R' has the formula

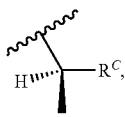

wherein $R^C$ is the remainder of the reversible terminator moiety.

Though one parameter, the average half time of nucleotide incorporation is measured over all four nucleotides (A, T, C, and G), and serves as a useful indicator of the enzyme kinetics. Described in Table 4 is the relative average half-time, Δt, which is defined as the difference in the half time of incorporation for the mutant relative to the half time of incorporation using SG1200 for the same terminator moiety, or $\Delta t = t_{mutant} - t_{SG1200}$. Because i-term has two possible isomers, both i-term1 and i-term2 are reported in Table 4.

TABLE 4

Reported relative average half time of incorporation for various reversible terminator probes.

| | Δt Aterm (s) | Δt S-term (s) | Δt i-term1 (s) | Δt i-term2 (s) |
|---|---|---|---|---|
| SG1200 | 0.00 | 0.00 | 0.00 | 0.00 |
| SG1210 | 4.83 | −0.44 | 14.00 | 16.60 |
| A61 | 6.57 | −7.89 | −35.10 | 14.60 |
| A56 | 7.10 | −6.00 | 22.30 | 41.80 |
| A62 | 2.97 | −6.44 | 52.60 | 22.30 |
| A65 | 1.23 | −8.74 | −48.70 | 1.10 |
| A49 | 5.73 | −6.40 | −40.30 | 9.70 |
| A59 | 1.15 | −5.55 | −28.10 | 12.10 |
| A39 | 35.50 | −1.88 | 31.10 | 64.10 |
| A69 | 14.14 | −3.52 | 1.40 | 36.90 |
| A70 | 21.93 | −2.63 | −5.50 | 23.00 |

Some of the mutant polymerases described in the table above incorporated A-term and i-term2 containing nucleotides approximately the same or slower rate, relative to SG1200. This is in contrast to S-term and i-term1 containing nucleotides, which observed a dramatic decrease in the incorporation half time, and further motivated our studies into exploring additional variants.

Additional mutant polymerases with S-term reversible terminator probes were explored. The results may be found in FIG. 1 and Table 5.

TABLE 5

Reported relative average half time of incorporation and fidelity scores for S-term reversible terminator probes.

| ID | Δt S-term (s) | Fidelity |
|---|---|---|
| SG1200 | 0.00 | 8.15 |
| SG1210 | −0.44 | 40.99 |
| SG1215 | 3.23 | 14.81 |
| SG1216 | 1.19 | 19.12 |
| SG1214 | 12.02 | 13.07 |
| SG1220 | 4.19 | 40.99 |
| SG1210-T5 | 2.89 | 32.27 |
| SG1210-T10 | 4.02 | 17.8 |
| SG1210-T13 | 3.33 | 22.89 |
| SG1210-T16 | 1.96 | 24.79 |
| SG1217 | −0.05 | 3.03 |
| SG1245 | 0.57 | 50.15 |
| SG1243 | −0.39 | 30.53 |
| SG1229 | 0.65 | 16.02 |
| SG1247 | −1.64 | 16.92 |
| SG1408 | 1.24 | 14.85 |
| SG1251 | −2.96 | 34.1 |

TABLE 5-continued

Reported relative average half time of incorporation and fidelity scores for S-term reversible terminator probes.

| ID | Δt S-term (s) | Fidelity |
|---|---|---|
| SG1253 | −2.39 | 65.06 |
| SG1257 | 0.55 | 20.39 |
| SG1250 | 5.56 | 16.35 |
| SG1227 | −4.41 | 13.1 |
| SG1433 | 4.38 | 19.79 |
| SG1235 | 3.91 | 11.35 |
| SG1236 | 1.53 | 10.67 |
| SG1237 | 2.69 | 7.23 |
| SG1266 | 0.08 | 6.8 |
| SG1262 | 5.08 | 6.73 |
| SG1264 | 3.92 | 8.53 |
| A61 | −7.89 | 19.56 |
| A56 | −6.00 | 34.16 |
| A62 | −6.44 | 16.12 |
| A65 | −8.74 | 9.92 |
| A49 | −6.40 | 14.6 |
| A59 | −5.55 | 15.28 |
| A39 | −1.88 | 16.37 |
| A69 | −3.52 | 13.85 |
| A70 | −2.63 | 20.92 |

Figure 2A:
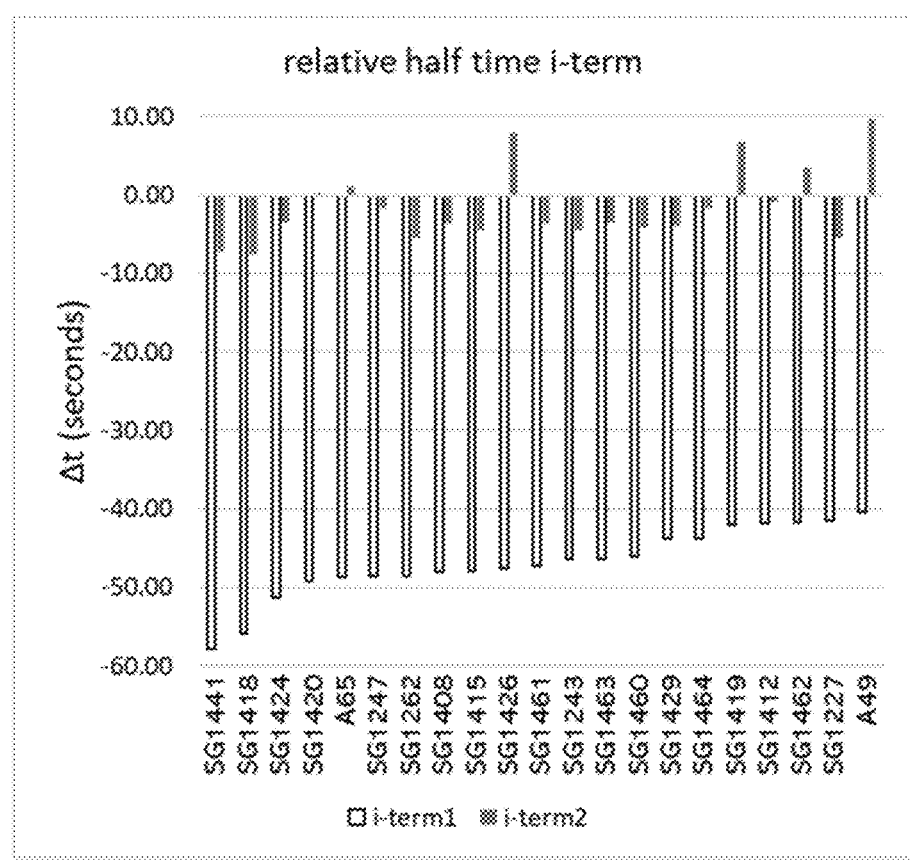
FIGS. 2A-C are charts showing the relative average halftime, Δt, for a series of mutants.
Figure 2B:
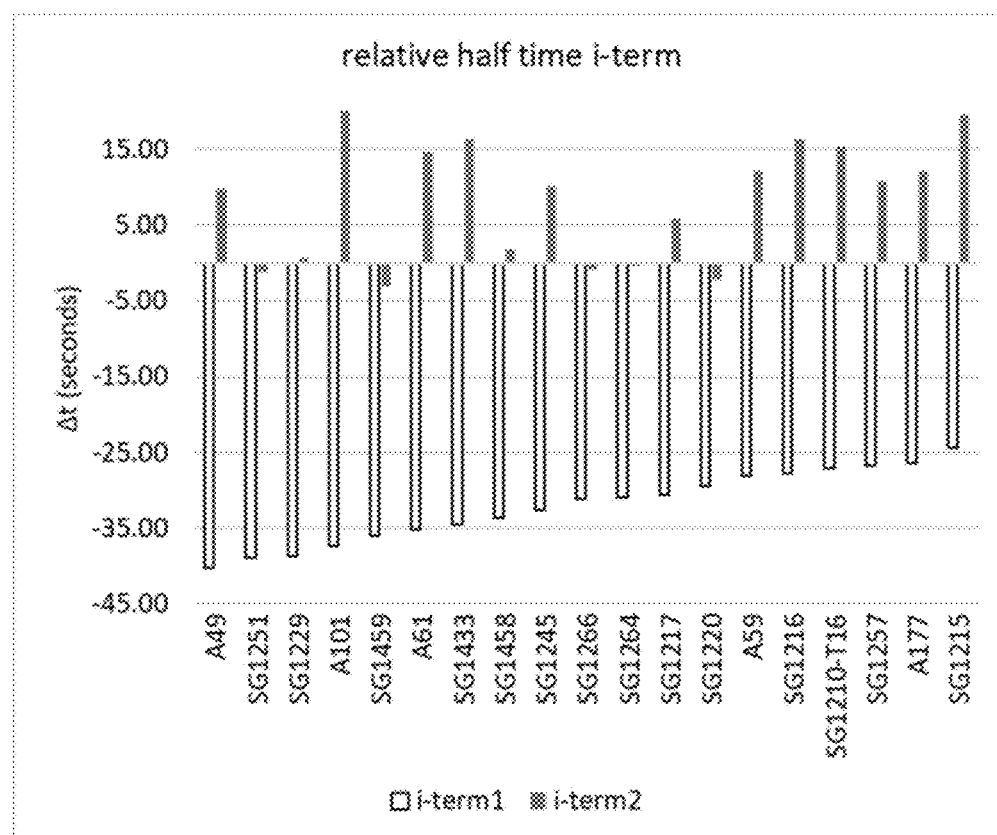
Figure 2C:
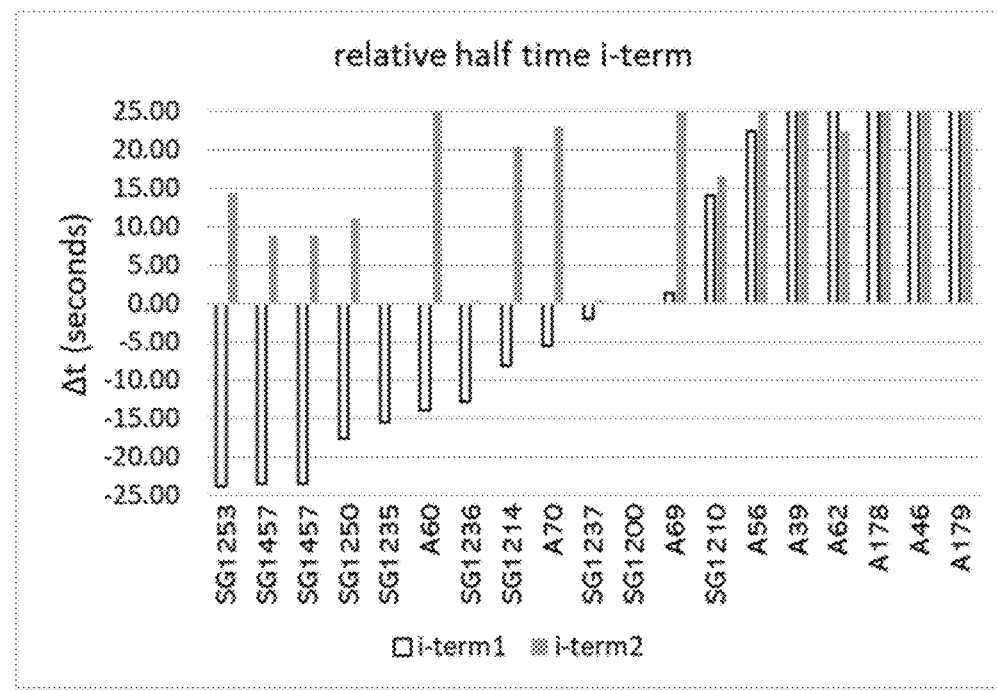
Figure 3A:
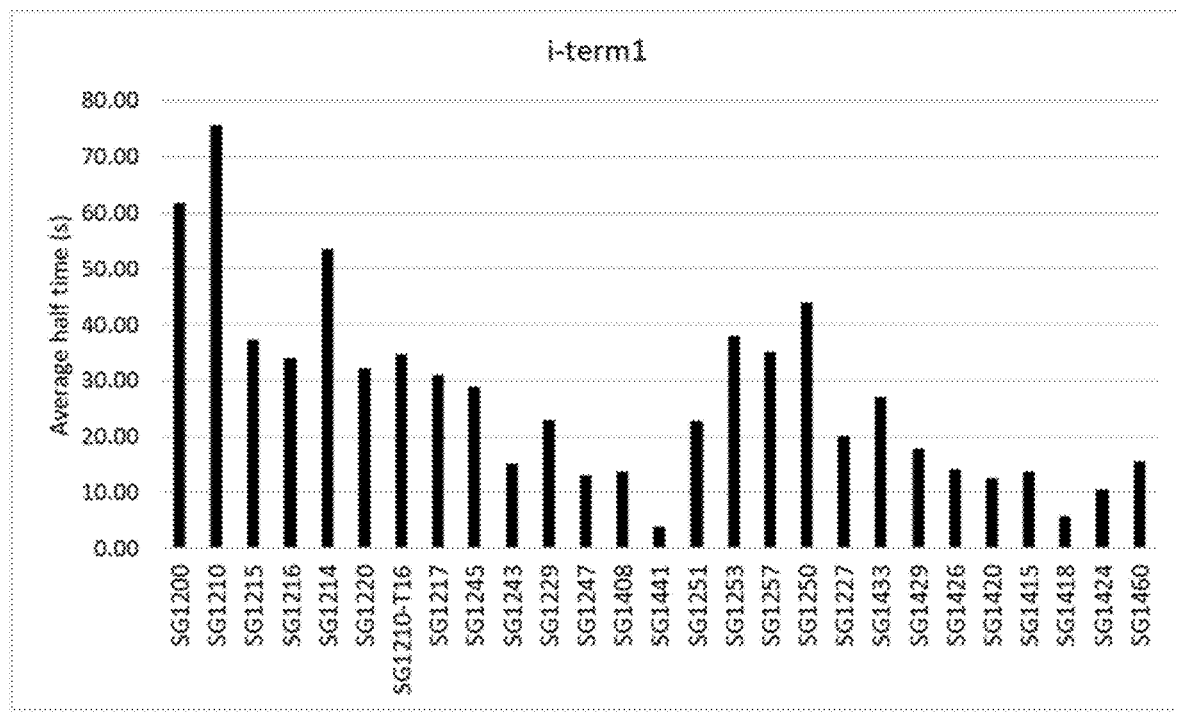
FIGS. 3A-D depict the measured absolute half time of incorporation of a modified nucleotide containing a reversible terminator moiety (i-term1 and i-term2), and a cleavable linker, where the cleavable linker is linking the fluorophore to the nucleotide. The data in the figure corresponds to the data presented in Table 5. The average is the average half time of incorporation for four different nucleotides, A, T, C, and G.
Figure 3B:
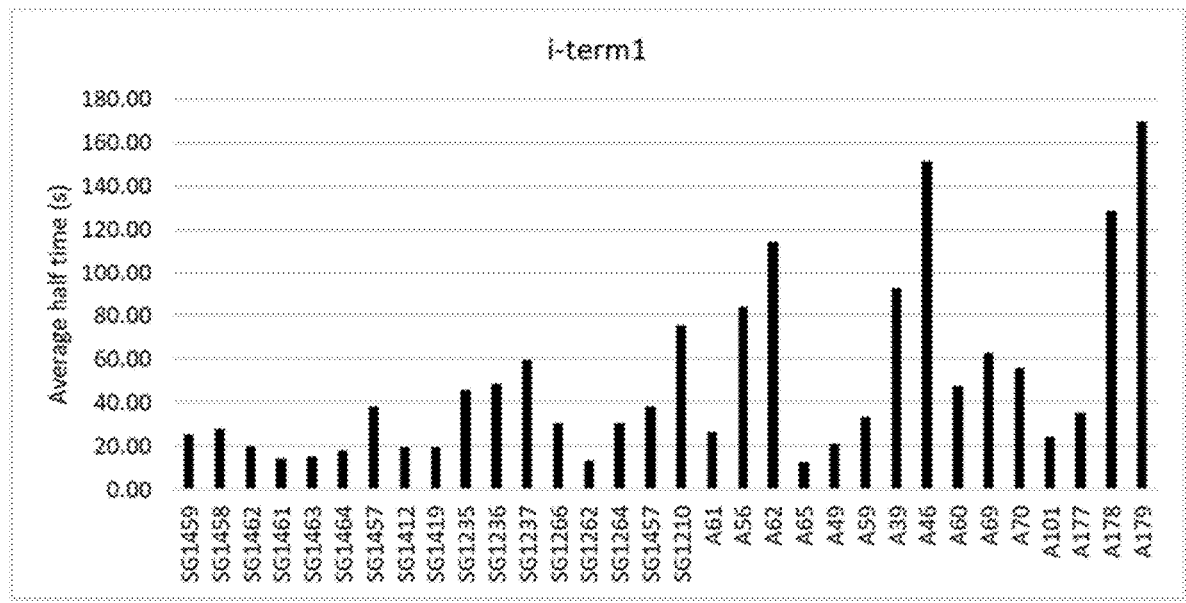
Figure 3C:
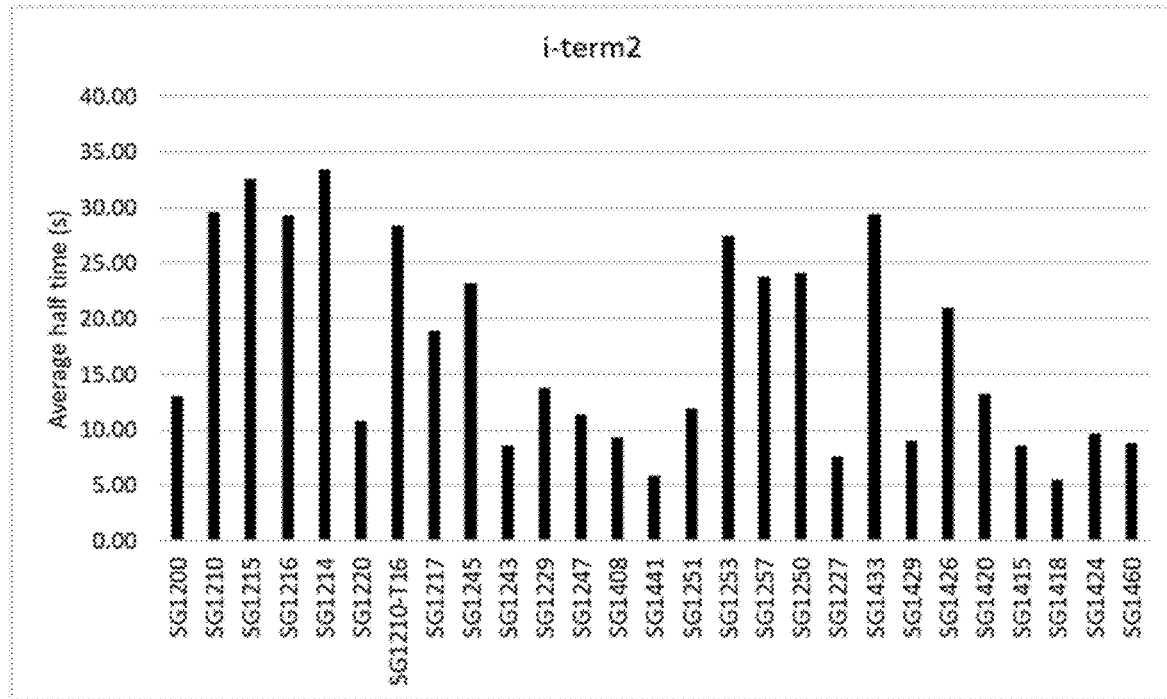
Figure 3D:
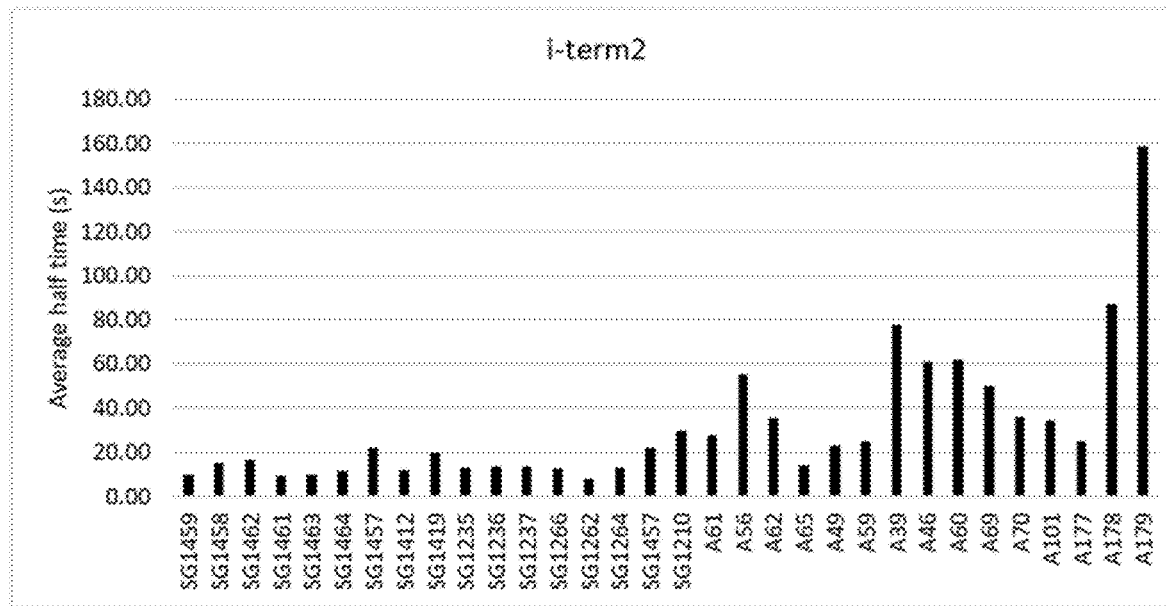

To date, the experiments described herein appear to be the first studies that have explored the effect of stereoisomeric differentiation in DNA polymerases. Shown in FIGS. 2A and 2B, as well as Table 6, are the results of these studies. Surprisingly, variants of the polymerase displayed preference for one isomer, as determined by the increased incorporation of i-term1 compared to i-term2.

The initial screening assays employed a modified nucleotide without a fluorophore or cleavable linker. In nucleic acid sequencing applications that utilize reversible terminating nucleotides, the modified nucleotide typically has a modified base (e.g., a base linked to a fluorophore via a cleavable linker). When the linker attaching the fluorophore to the base is cleaved there is usually a residual spacer arm left after the cleavage. This residual modification may interfere with incorporation of subsequent nucleotides by polymerase. Therefore, we explored if these mutant polymerases are tolerable of these scars by measuring the incorporation rate of a fully modified nucleotide (i.e. a nucleotide comprising a reversible terminator, cleavable linker, and fluorophore).

Table 6 provides measured average absolute half time of incorporation of a modified nucleotide containing a reversible terminator moiety (i-term1 and i-term2), and a cleavable linker, where the cleavable linker is linking the fluorophore to the nucleotide. The average is the average half time of incorporation for four different nucleotides, A, T, C, and G. The data in the table corresponds to FIGS. 3A-D.

TABLE 6

Average absolute half time of incorporation of a modified nucleotide.

| Enzyme | Average Half-Time i-term1 (s) | Average Half-Time i-term2 (s) |
|---|---|---|
| SG1200 | 61.70 | 13.10 |
| SG1210 | 75.70 | 29.70 |
| SG1215 | 37.40 | 32.60 |
| SG1216 | 34.00 | 29.40 |
| SG1214 | 53.60 | 33.50 |
| SG1220 | 32.20 | 10.80 |
| SG1210-T16 | 34.60 | 28.40 |

TABLE 6-continued

Average absolute half time of incorporation of a modified nucleotide.

| Enzyme | Average Half-Time i-term1 (s) | Average Half-Time i-term2 (s) |
|---|---|---|
| SG1217 | 31.00 | 18.90 |
| SG1245 | 29.00 | 23.20 |
| SG1243 | 15.30 | 8.70 |
| SG1229 | 23.00 | 13.80 |
| SG1247 | 13.20 | 11.40 |
| SG1408 | 13.70 | 9.40 |
| SG1441 | 3.90 | 5.90 |
| SG1251 | 22.80 | 11.90 |
| SG1253 | 37.90 | 27.50 |
| SG1257 | 35.00 | 23.80 |
| SG1250 | 44.00 | 24.10 |
| SG1227 | 20.20 | 7.60 |
| SG1433 | 27.20 | 29.50 |
| SG1429 | 17.90 | 9.10 |
| SG1426 | 14.20 | 21.00 |
| SG1420 | 12.50 | 13.30 |
| SG1415 | 13.80 | 8.70 |
| SG1418 | 5.80 | 5.50 |
| SG1424 | 10.40 | 9.70 |
| SG1460 | 15.60 | 8.90 |
| SG1459 | 25.70 | 10.10 |
| SG1458 | 28.10 | 14.90 |
| SG1462 | 20.00 | 16.60 |
| SG1461 | 14.50 | 9.50 |
| SG1463 | 15.30 | 9.70 |
| SG1464 | 17.90 | 11.40 |
| SG1457 | 38.20 | 21.90 |
| SG1412 | 19.80 | 12.20 |
| SG1419 | 19.70 | 19.90 |
| SG1235 | 46.20 | 12.90 |
| SG1236 | 48.90 | 13.40 |
| SG1237 | 59.70 | 13.60 |
| SG1266 | 30.60 | 12.30 |
| SG1262 | 13.20 | 7.60 |
| SG1264 | 30.70 | 12.80 |
| SG1457 | 38.20 | 21.90 |
| SG1210 | 75.70 | 29.70 |
| A61 | 26.60 | 27.70 |
| A56 | 84.00 | 54.90 |
| A62 | 114.30 | 35.40 |
| A65 | 13.00 | 14.20 |
| A49 | 21.40 | 22.80 |
| A59 | 33.60 | 25.20 |
| A39 | 92.80 | 77.20 |
| A46 | 151.40 | 60.70 |
| A60 | 47.70 | 61.80 |
| A69 | 63.10 | 50.00 |
| A70 | 56.20 | 36.10 |
| A101 | 24.30 | 34.30 |
| A177 | 35.30 | 25.20 |
| A178 | 128.90 | 86.90 |
| A179 | 169.70 | 158.40 |

Example 4: Measuring Enzyme Fidelity

The fidelity of a DNA polymerase is the result of accurate replication of a desired template. Specifically, this involves multiple steps, including the ability to read a template strand, select the appropriate nucleoside triphosphate and insert the correct nucleotide at the 3' primer terminus, such that Watson-Crick base pairing is maintained. In addition to effective discrimination of correct versus incorrect nucleotide incorporation, some DNA polymerases possess a 3'→5' exonuclease activity. This activity, known as "proofreading", is used to excise incorrectly incorporated mononucleotides that are then replaced with the correct nucleotide.

High-fidelity DNA polymerases have safeguards to protect against both making and propagating mistakes while copying DNA. Such mutated polymerases have a significant binding preference for the correct versus the incorrect nucleoside triphosphate during polymerization. If an incorrect nucleotide does bind in the polymerase active site, incorporation is slowed due to the sub-optimal architecture of the active site complex (e.g., within motif A or the exonuclease domain). This lag time increases the opportunity for the incorrect nucleotide to dissociate before polymerase progression, thereby allowing the process to start again, with a correct nucleoside triphosphate. If an incorrect nucleotide is inserted, the perturbation caused by the mispaired bases is detected, and the polymerase moves the 3' end of the growing DNA chain into a proofreading 3'→5' exonuclease domain. There, the incorrect nucleotide is removed by the 3'→5' exonuclease activity, whereupon the chain is moved back into the polymerase domain, where polymerization can continue.

Fidelity of the polymerase may be quantified using any suitable method known in the art. For example, to quantify the fidelity we do a single nucleotide extension where the next base to be incorporated is known (e.g., A) in the presence of excess incorrect nucleotide (e.g., G). For example, the enzyme, template, primer composition is mixed with 5 mM dATP and 500 mM dGTP (the most likely misincorporation), to probe nucleotide incorporation with 100-fold excess of the wrong nucleotide. The reported fidelity score is the signal (relative fluorescence units) from the correct base divided by the signal from the incorrect base. Therefore, a higher the fidelity score corresponds to a lower rate of misincorporation (i.e., incorporating the incorrect nucleotide).

Example 5: Rationale for Design of SG1200

In the context of nucleic acid sequencing, the use of nucleotides bearing a 3' reversible terminator allows successive nucleotides to be incorporated into a polynucleotide chain in a controlled manner. The DNA template for a sequencing reaction will typically comprise a double-stranded region having a free 3' hydroxyl group which serves as a primer or initiation point for the addition of further nucleotides in the sequencing reaction. The region of the DNA template to be sequenced will overhang this free 3' hydroxyl group on the complementary strand. The primer bearing the free 3' hydroxyl group may be added as a separate component (e.g. a short oligonucleotide) which hybridizes to a region of the template to be sequenced. Following the addition of a single nucleotide to the DNA template, the presence of the 3' reversible terminator prevents incorporation of a further nucleotide into the polynucleotide chain. While the addition of subsequent nucleotides is prevented, the identity of the incorporated is detected (e.g., exciting a unique detectable label that is linked to the incorporated nucleotide). The reversible terminator is then removed, leaving a free 3' hydroxyl group for addition of the next nucleotide. The sequencing cycle can then continue with the incorporation of the next blocked, labelled nucleotide.

Sequencing by synthesis of nucleic acids ideally requires the controlled (i.e. one at a time), yet rapid, incorporation of the correct complementary nucleotide opposite the oligonucleotide being sequenced. This allows for accurate sequencing by adding nucleotides in multiple cycles as each nucleotide residue is sequenced one at a time, thus preventing an uncontrolled series of incorporations occurring.

As described herein wild-type *Pyrococcus abyssi* has difficulty incorporating modified nucleotides (e.g., nucleotides including a reversible terminator and/or a cleavable linked base). A minimum set of mutations is necessary to modify the exonuclease activity and permit incorporation. For example mutations at D141 and E143 which are known to affect exo activity (Southworth et al, 1996 Proc. Natl Acad. Sci USA 93:5281). As described in WO 2005/024010, modifications to the so-called motif A region, 408-410 of 9° N polymerases, exhibit improved incorporation of nucleotide analogues bearing substituents at the 3' position of the sugar. Note, amino acids at positions 408, 409, 410 in a 9° N polymerase are functionally equivalent to amino acids 409, 410, and 411 in wild type *P. abyssi*. This trio of amino acids are in close proximity to the nucleotide that is being incorporated.

For brevity, amino acid mutation nomenclature is used throughout this application. One having skill in the art would understand the amino acid mutation nomenclature, such that D141A refers to aspartic acid (single letter code is D), at position 141, is replaced with alanine (single letter code A). Likewise, it is understood that when an amino acid mutation nomenclature is used and the terminal amino acid code is missing, e.g., P411, it is understood that no mutation was made relative to the wild type.

While the aforementioned mutations were conducted in other thermostable enzymes (e.g., *Thermococcus* 9° N-7, Pfu, relying on the suggested mutation described above, the first mutated enzyme, SG1100, has the following mutations D141A, E143A, L4095, Y410A, and P411V which permits incorporation of modified nucleotides. Polymerase SG1100 has variations analogous to Terminator III. Additional research (e.g., Gardner, A. F. and Jack, W. E. (1999) Nucleic Acids Research 27, 2545-2555; Gardner and Jack, 2002. Nucl. Acids Res. 30:605; and Arezi et al., 2002. J. Mol. Biol. 322:719) suggested that mutations at 485 of SEQ ID NO: 209 (which is a *Thermococcus* 9° N sequence and the number is in relation to the sequence of *Thermococcus* 9° N) enhanced the incorporation of nucleotide analogues that lack a 3' sugar hydroxyl moiety (acyNTPs and dideoxyNTPs).

These foundation mutations were incorporated into the enzyme SG1200. For the purposes of comparing additional mutant polymerases, all comparisons will be made relative to SG1200, where SG1200 has the following mutations: M129A, D141A, E143A, L409A, Y410A, P411I, and A486V.

Example 6: Mutational Analysis of Motif A

Through site directed mutagenesis and computational models, key mutations in the motif A region (i.e., the three amino acids functionally equivalent or homologous to amino acids 409, 410, and 411 in wild type *P. Abyssi*) were determined to include SAP, SAV, SGI, AGP, and AGI. Note when amino acid position 411 is proline, this corresponds to the wild-type amino acid. As described in WO 2005/024010, it was widely believed that modifications to the motif A region are required to incorporate nucleotide analogues; and so it was surprising to find that only modifying positions 409 and 410 in the motif A region not only resulted in the incorporation of a modified nucleotide, but significantly improved incorporation kinetics (e.g., comparing SG1200 to SG1441). Table 6 includes additional mutants with these motif A region modifications, as well as other modifications to the backbone to improve DNA binding, improve modified nucleotide incorporation, and deter exonuclease activity. Interestingly, particular combinations of mutants permit differentiation for isomeric reversible terminators.

As shown in Table 7, additional polymerase mutants with modifications to key mutations in the motif A region (i.e., the three amino acids functionally equivalent or homologous to amino acids 409, 410, and 411 in wild type *P. Abyssi*) include SAP, SAV, SGI, AGP, and AGI. Note, for example, AGI corresponds to the mutations L409A, Y410G, and P411I; when motif A is AGP this corresponds to mutations in amino acid positions 409 and 410 (i.e., L409A and Y410G) and amino acid position 411 is proline, the wild type amino acid denoted by the symbol P. The mutations in this table are mutations relative to the wild type *P. abyssi* (SEQ ID NO:1).

TABLE 7

List of mutations in variant polymerases

| Motif A | New Variant | Key Mutations |
| --- | --- | --- |
| AGI | SG1494 | M129A; D141A; E143A; T144A; L409A; Y410G; P411I; A486V; T515S; T590I; G153E; K712E |
|  | SG1495 | M129A; D141A; E143A; T144A; L409A; Y410G; P411I; A486V; T515S; T590I; G153E; I522L |
|  | SG1496 | M129A; D141A; E143A; T144A; L409A; Y410G; P411I; A486L; T515S; T590I; G153E |
|  | SG1497 | M129A; D141A; E143A; T144A; L409A; Y410G; P411I; A486V; T515S; T590I; G153E; K602A |
|  | SG1498 | M129A; D141A; E143A; T144A; L409A; Y410G; P411I; A486V; T515S; T590I; G153E; N735A |
|  | SG1499 | M129A; D141A; E143A; T144A; L409A; Y410G; P411I; A486V; T515S; T590I; G153E; K477A |
|  | SG1600 | M129A; D141A; E143A; T144A; L409A; Y410G; P411I; A486V; T515S; T590I; G153E; K478A |
|  | SG1601 | M129A; D141A; E143A; T144A; L409A; Y410G; P411I; A486V; T515S; T590I; G153E; L479S |
|  | SG1602 | M129A; D141A; E143A; T144A; L409A; Y410G; P411I; A486V; T515S; T590I; G153E; K477A; K478A; L479S |
|  | SG1603 | M129A; D141A; E143A; T144A; L409A; Y410G; P411I; A486V; T515S; T590I; G153E; A639L |
|  | SG1604 | M129A; D141A; E143A; T144A; L409A; Y410G; P411I; A486V; T515S; T590I; G153E; R705A |
|  | SG1605 | M129A; D141A; E143A; T144A; L409A; Y410G; P411I; A486V; T515S; T590I; G153E; E718A |
|  | SG1606 | M129A; D141A; E143A; T144A; L409A; Y410G; P411I; A486V; T515S; T590I; G153E; R713A |
|  | SG1607 | M129A; D141A; E143A; T144A; L409A; Y410G; P411I; A486V; T515S; T590I; G153E; D215A |
|  | SG1608 | M129A; D141A; E143A; T144A; L409A; Y410G; P411I; A486V; T515S; T590I; G153E; D315A |
|  | SG1609 | M129A; D141A; E143A; T144A; L409A; Y410G; P411I; A486V; T515S; T590I; G153E; D215A; D315A |
| AGI | SG1610 | M129A; D141A; E143A; T144A; L409A; Y410G; P411I; A486V; T515S; T590I; G153E; K712E; i522I |
|  | SG1611 | M129A; D141A; E143A; T144A; L409A; Y410G; P411I; A486L; T515S; T590I; G153E; K712E |
|  | SG1612 | M129A; D141A; E143A; T144A; L409A; Y410G; P411I; A486V; T515S; T590I; G153E; K712E; K602A |
|  | SG1613 | M129A; D141A; E143A; T144A; L409A; Y410G; P411I; A486V; T515S; T590I; G153E; K712E; N735A |
|  | SG1614 | M129A; D141A; E143A; T144A; L409A; Y410G; P411I; A486V; T515S; T590I; G153E; K712E; K477A |
|  | SG1615 | M129A; D141A; E143A; T144A; L409A; Y410G; P411I; A486V; T515S; T590I; G153E; K712E; K478A |
|  | SG1616 | M129A; D141A; E143A; T144A; L409A; Y410G; P411I; A486V; T515S; T590I; G153E; K712E; L479S |
|  | SG1617 | M129A; D141A; E143A; T144A; L409A; Y410G; P411I; A486V; T515S; T590I; G153E; K712E; K477A; K478A; L479S |
|  | SG1618 | M129A; D141A; E143A; T144A; L409A; Y410G; P411I; A486V; T515S; T590I; G153E; K712E; A639L |
|  | SG1619 | M129A; D141A; E143A; T144A; L409A; Y410G; P411I; A486V; T515S; T590I; G153E; K712E; R705A |
|  | SG1620 | M129A; D141A; E143A; T144A; L409A; Y410G; P411I; A486V; T515S; T590I; G153E; K712E; E718A |
|  | SG1621 | M129A; D141A; E143A; T144A; L409A; Y410G; P411I; A486V; T515S; T590I; G153E; K712E; R713A |
|  | SG1622 | M129A; D141A; E143A; T144A; L409A; Y410G; P411I; A486V; T515S; T590I; G153E; K712E; D215A |
|  | SG1623 | M129A; D141A; E143A; T144A; L409A; Y410G; P411I; A486V; T515S; T590I; G153E; K712E; D315A |
|  | SG1624 | M129A; D141A; E143A; T144A; L409A; Y410G; P411I; A486V; T515S; T590I; G153E; K712E; D215A; D315A |
| AGP | SG1625 | M129A; D141A; T144A; E143A; L409A; Y410G; A486V; T515S; T590I; G153E |
|  | SG1626 | M129A; D141A; T144A; E143A; L409A; Y410G; A486V; T515S; T590I; G153E; K712E |

TABLE 7-continued

List of mutations in variant polymerases

| Motif A | New Variant | Key Mutations |
|---|---|---|
| | SG1627 | M129A; D141A; E143A; T144A; L409A; Y410G; A486V; T515S; T590I; G153E; i522I |
| | SG1628 | M129A; D141A; E143A; T144A; L409A; Y410G; A486L; T515S; T590I; G153E |
| | SG1629 | M129A; D141A; E143A; T144A; L409A; Y410G; A486V; T515S; T590I; G153E; K602A |
| | SG1630 | M129A; D141A; E143A; T144A; L409A; Y410G; A486V; T515S; T590I; G153E; N735A |
| | SG1631 | M129A; D141A; E143A; T144A; L409A; Y410G; A486V; T515S; T590I; G153E; K477A |
| | SG1632 | M129A; D141A; E143A; T144A; L409A; Y410G; A486V; T515S; T590I; G153E; K478A |
| | SG1633 | M129A; D141A; E143A; T144A; L409A; Y410G; A486V; T515S; T590I; G153E; L479S |
| | SG1634 | M129A; D141A; E143A; T144A; L409A; Y410G; A486V; T515S; T590I; G153E; K477A; K478A; L479S |
| | SG1635 | M129A; D141A; E143A; T144A; L409A; Y410G; A486V; T515S; T590I; G153E; A639L |
| | SG1636 | M129A; D141A; E143A; T144A; L409A; Y410G; A486V; T515S; T590I; G153E; R705A |
| | SG1637 | M129A; D141A; E143A; T144A; L409A; Y410G; A486V; T515S; T590I; G153E; E718A |
| | SG1638 | M129A; D141A; E143A; T144A; L409A; Y410G; A486V; T515S; T590I; G153E; R713A |
| | SG1639 | M129A; D141A; E143A; T144A; L409A; Y410G; A486V; T515S; T590I; G153E; D215A |
| | SG1640 | M129A; D141A; E143A; T144A; L409A; Y410G; A486V; T515S; T590I; G153E; D315A |
| | SG1641 | M129A; D141A; E143A; T144A; L409A; Y410G; A486V; T515S; T590I; G153E; D215A; D315A |
| AGP | SG1642 | M129A; D141A; E143A; T144A; L409A; Y410G; A486V; T515S; T590I; G153E; K712E; I522I |
| | SG1643 | M129A; D141A; E143A; T144A; L409A; Y410G; A486L; T515S; T590I; G153E; K712E |
| | SG1644 | M129A; D141A; E143A; T144A; L409A; Y410G; A486V; T515S; T590I; G153E; K712E; K602A |
| | SG1645 | M129A; D141A; E143A; T144A; L409A; Y410G; A486V; T515S; T590I; G153E; K712E; N735A |
| | SG1646 | M129A; D141A; E143A; T144A; L409A; Y410G; A486V; T515S; T590I; G153E; K712E; K477A |
| | SG1647 | M129A; D141A; E143A; T144A; L409A; Y410G; A486V; T515S; T590I; G153E; K712E; K478A |
| | SG1648 | M129A; D141A; E143A; T144A; L409A; Y410G; A486V; T515S; T590I; G153E; K712E; L479S |
| | SG1649 | M129A; D141A; E143A; T144A; L409A; Y410G; A486V; T515S; T590I; G153E; K712E; K477A; K478A; L479S |
| | SG1650 | M129A; D141A; E143A; T144A; L409A; Y410G; A486V; T515S; T590I; G153E; K712E; A639L |
| | SG1651 | M129A; D141A; E143A; T144A; L409A; Y410G; A486V; T515S; T590I; G153E; K712E; R705A |
| | SG1652 | M129A; D141A; E143A; T144A; L409A; Y410G; A486V; T515S; T590I; G153E; K712E; E718A |
| | SG1653 | M129A; D141A; E143A; T144A; L409A; Y410G; A486V; T515S; T590I; G153E; K712E; R713A |
| | SG1654 | M129A; D141A; E143A; T144A; L409A; Y410G; A486V; T515S; T590I; G153E; K712E; D215A |
| | SG1655 | M129A; D141A; E143A; T144A; L409A; Y410G; A486V; T515S; T590I; G153E; K712E; D315A |
| | SG1656 | M129A; D141A; E143A; T144A; L409A; Y410G; A486V; T515S; T590I; G153E; K712E; D215A; D315A |
| SGI | SG1657 | M129A; D141A; E143A; T144A; L409S; Y410G; P411I; A486V; T515S; T590I; G153E |
| | SG1658 | M129A; D141A; E143A; T144A; L409S; Y410G; P411I; A486V; T515S; T590I; G153E; K712E |
| | SG1659 | M129A; D141A; E143A; T144A; L409S; Y410G; P411I; A486V; T515S; T590I; G153E; I522L |
| | SG1660 | M129A; D141A; E143A; T144A; L409S; Y410G; P411I; A486L; T515S; T590I; G153E |
| | SG1661 | M129A; D141A; E143A; T144A; L409S; Y410G; P411I; A486V; T515S; T590I; G153E; K602A |
| | SG1662 | M129A; D141A; E143A; T144A; L409S; Y410G; P411I; A486V; T515S; T590I; G153E; N735A |
| | SG1663 | M129A; D141A; E143A; T144A; L409S; Y410G; P411I; A486V; T515S; T590I; G153E; K477A |

TABLE 7-continued

List of mutations in variant polymerases

| Motif A | New Variant | Key Mutations |
|---|---|---|
| | SG1664 | M129A; D141A; E143A; T144A; L409S; Y410G; P411I; A486V; T515S; T590I; G153E; K478A |
| | SG1665 | M129A; D141A; E143A; T144A; L409S; Y410G; P411I; A486V; T515S; T590I; G153E; L479S |
| | SG1666 | M129A; D141A; E143A; T144A; L409S; Y410G; P411I; A486V; T515S; T590I; G153E; K477A; K478A; L479S |
| | SG1667 | M129A; D141A; E143A; T144A; L409S; Y410G; P411I; A486V; T515S; T590I; G153E; A639L |
| | SG1668 | M129A; D141A; E143A; T144A; L409S; Y410G; P411I; A486V; T515S; T590I; G153E; R705A |
| | SG1669 | M129A; D141A; E143A; T144A; L409S; Y410G; P411I; A486V; T515S; T590I; G153E; E718A |
| | SG1670 | M129A; D141A; E143A; T144A; L409S; Y410G; P411I; A486V; T515S; T590I; G153E; R713A |
| | SG1671 | M129A; D141A; E143A; T144A; L409S; Y410G; P411I; A486V; T515S; T590I; G153E; D215A |
| | SG1672 | M129A; D141A; E143A; T144A; L409S; Y410G; P411I; A486V; T515S; T590I; G153E; D315A |
| | SG1673 | M129A; D141A; E143A; T144A; L409S; Y410G; P411I; A486V; T515S; T590I; G153E; D215A; D315A |
| SAV | SG1326 | D141A; E143A; T144A; L409S; Y410A; P411V; A486V; T515S; T590I; G153E |
| | SG1327 | D141A; E143A; T144A; L409S; Y410A; P411V; A486V; T515S; T590I; K712E |
| | SG1328 | D141A; E143A; T144A; L409S; Y410A; P411V; A486V; T515S; T590I; I522L |
| | SG1329 | D141A; E143A; T144A; L409S; Y410A; P411V; A486L; T515S; T590I |
| | SG1330 | D141A; E143A; T144A; L409S; Y410A; P411V; A486V; T515S; T590I; K602A |
| | SG1331 | D141A; E143A; T144A; L409S; Y410A; P411V; A486V; T515S; T590I; N735A |
| | SG1332 | D141A; E143A; T144A; L409S; Y410A; P411V; A486V; T515S; T590I; K477A |
| | SG1333 | D141A; E143A; T144A; L409S; Y410A; P411V; A486V; T515S; T590I; K478A |
| | SG1334 | D141A; E143A; T144A; L409S; Y410A; P411V; A486V; T515S; T590I; L479S |
| | SG1335 | D141A; E143A; T144A; L409S; Y410A; P411V; A486V; T515S; T590I; K477A; K478A; L479S |
| | SG1336 | D141A; E143A; T144A; L409S; Y410A; P411V; A486V; T515S; T590I; A639L |
| | SG1337 | D141A; E143A; T144A; L409S; Y410A; P411V; A486V; T515S; T590I; R705A |
| | SG1338 | D141A; E143A; T144A; L409S; Y410A; P411V; A486V; T515S; T590I; E718A |
| | SG1339 | D141A; E143A; T144A; L409S; Y410A; P411V; A486V; T515S; T590I; R713A |
| | SG1340 | D141A; E143A; T144A; L409S; Y410A; P411V; A486V; T515S; T590I; D215A |
| | SG1341 | D141A; E143A; T144A; L409S; Y410A; P411V; A486V; T515S; T590I; D315A |
| | SG1342 | D141A; E143A; T144A; L409S; Y410A; P411V; A486V; T515S; T590I; D215A; D315A |
| SAP | SG1343 | D141A; E143A; T144A; L409S; Y410A; A486V; T515S; T590I; G153E |
| | SG1344 | D141A; E143A; T144A; L409S; Y410A; A486V; T515S; T590I; K712E |
| | SG1345 | D141A; E143A; T144A; L409S; Y410A; A486V; T515S; T590I; I522L |
| | SG1346 | D141A; E143A; T144A; L409S; Y410A; A486L; T515S; T590I |
| | SG1347 | D141A; E143A; T144A; L409S; Y410A; A486V; T515S; T590I; K602A |
| | SG1348 | D141A; E143A; T144A; L409S; Y410A; A486V; T515S; T590I; N735A |
| | SG1349 | D141A; E143A; T144A; L409S; Y410A; A486V; T515S; T590I; K477A |
| | SG1350 | D141A; E143A; T144A; L409S; Y410A; A486V; T515S; T590I; K478A |
| | SG1351 | D141A; E143A; T144A; L409S; Y410A; A486V; T515S; T590I; L479S |
| | SG1352 | D141A; E143A; T144A; L409S; Y410A; A486V; T515S; T590I; K477A; K478A; L479S |
| | SG1353 | D141A; E143A; T144A; L409S; Y410A; A486V; T515S; T590I; A639L |
| | SG1354 | D141A; E143A; T144A; L409S; Y410A; A486V; T515S; T590I; R705A |
| | SG1355 | D141A; E143A; T144A; L409S; Y410A; A486V; T515S; T590I; E718A |
| | SG1356 | D141A; E143A; T144A; L409S; Y410A; A486V; T515S; T590I; R713A |
| | SG1357 | D141A; E143A; T144A; L409S; Y410A; A486V; T515S; T590I; D215A |
| | SG1358 | D141A; E143A; T144A; L409S; Y410A; A486V; T515S; T590I; D315A |
| | SG1359 | D141A; E143A; T144A; L409S; Y410A; A486V; T515S; T590I; D215A; D315A |

A summary table compiling the kinetics, as determined by the incorporation half time for each reversible terminator for a selection of the mutants is depicted in Table 8, alongside their key mutations relative to wild type *P. abyssi* (SEQ ID NO:1).

Described in the table are the mutant variants and their mutations relative to the wild type *P. abyssi*. The relative average half time for each reversible terminator moiety is included, wherein the relative average halftime, $\Delta t$, is defined as the difference in the half time of incorporation for the mutant relative to the half time of incorporation using SG1200 for the same terminator moiety, or $\Delta t = t_{mutant} - t_{SG1200}$. For relative average half having the double dashed symbol, --, the incorporation rate was not measured and does not necessarily imply the incorporation rate cannot be measured.

TABLE 8

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| A2 | D141A E143A L409A Y410A P411V | — | — | −0.34 | 12.89 |
| A25 | D141A E143A L409S Y410A P411P | — | — | −9.74 | — |
| A39 | M129A D141A E143A L409G Y410G P411I A486V | 31.10 | 64.10 | −1.88 | 35.50 |
| A46 | M129A D141A E143A L409Y Y410G P411I A486V | 89.70 | 47.60 | — | — |
| A49 | M129A D141A E143A L409S Y410G P411I A486V | −40.30 | 9.70 | −6.40 | 5.73 |
| A56 | M129A D141A E143A L409H Y410G P411I A486V | 22.30 | 41.80 | −6.00 | 7.10 |
| A59 | M129A D141A E143A L409A Y410G P411G A486V | −28.10 | 12.10 | −5.55 | 1.15 |
| A60 | M129A D141A E143A L409A Y410G P411A A486V | −14.00 | 48.70 | — | — |
| A61 | M129A D141A E143A L409A Y410G P411V A486V | −35.10 | 14.60 | −7.89 | 6.57 |
| A62 | M129A D141A E143A L409A Y410G P411L A486V | 52.60 | 22.30 | −6.44 | 2.97 |
| A65 | M129A D141A E143A L409A Y410G P411 A486V | −48.70 | 1.10 | −8.74 | 1.23 |
| A69 | M129A D141A E143A L409A Y410G P411S A486V | 1.40 | 36.90 | −3.52 | 14.14 |
| A70 | M129A D141A E143A L409A Y410G P411T A486V | −5.50 | 23.00 | −2.63 | 21.93 |
| A101 | M129A D141A E143A L409S Y410G P411S A486V | −37.40 | 21.20 | — | — |
| A177 | M129A D141A E143A L409Q Y410A P411I A486V | −26.40 | 12.10 | — | — |
| A178 | M129A D141A E143A L409W Y410S P411C A486V | 67.20 | 73.80 | — | — |
| A179 | M129A D141A E143A L409F Y410S P411A A486V | 108.00 | 145.30 | — | — |
| SG1100 | D141A E143A L409S Y410A P411V | — | — | 1.46 | 32.07 |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1105 | D141A E143A L409S Y410A P411V A486V | — | — | −3.57 | 6.25 |
| SG1107 | D141A E143A L409S Y410A P411V A486L | — | — | — | — |
| SG1124 | D141A D143A L409S Y410A P411V L479S A486V | — | — | −1.28 | — |
| SG1130 | D141A D143A L409S Y410A P411V A486V E718N | — | — | −2.83 | — |
| SG1132 | D141A E143A L409S Y410A P411V T515S A486V | — | — | 2.77 | — |
| SG1134 | D141A E143A L409S Y410A P411V T590I A486V | — | — | 4.67 | — |
| SG1143 | D141A E143A T144A L409S Y410A P411V A486V T515S | — | — | −1.26 | — |
| SG1145 | D141A E143A T144A L409S Y410A P411V A486V T590I | — | — | 1.24 | — |
| SG1146 | D141A E143A L409S Y410A P411V A486V T515S I522L | — | — | −2.50 | — |
| SG1147 | D141A E143A L409S Y410A P411V A486V T515S T590I | — | — | −6.32 | — |
| SG1154 | D141A D143A L409S Y410A P411V K477A A486V | — | — | −1.01 | — |
| SG1155 | D141A D143A L409S Y410A P411V L479A A486V | — | — | −3.04 | — |
| SG1156 | D141A D143A L409S Y410A P411V K478A A486V | — | — | −4.24 | — |
| SG1160 | D141A D143A L409S Y410A P411V A486V K712E | — | — | −4.92 | — |
| SG1161 | D141A D143A L409S Y410A P411V A486V K712A | — | — | −4.24 | — |
| SG1194 | D141A E143A T144A L409S Y410A P411V A486V T515S T590I | — | — | −5.36 | — |
| SG1200 | M129A D141A E143A L409A Y410A P411I A486V | 0.00 | 0.00 | 0.00 | 0.00 |
| SG1210 | M129A D141A E143A L409A Y410G P411I A486V | 14.00 | 16.60 | −0.44 | 4.83 |
| SG1210-T10 | M129A D141A E143A L409A Y410G P411I A486V (T10 refers to truncation of 10 amino | — | — | 4.02 | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1210-T13 | M129A D141A E143A L409A Y410G P411I A486V (T13 refers to truncation of 13 amino acids at the C-terminus) | — | — | 3.33 | — |
| SG1210-T16 | M129A D141A E143A L409A Y410G P411I A486V T16 (T16 refers to truncation of 16 amino acids at the C-terminus) | −27.10 | 15.30 | 1.96 | — |
| SG1210-T5 | M129A D141A E143A L409A Y410G P411I A486V T5 (T5 refers to truncation of 5 amino acids at the C-terminus) | — | — | 2.89 | — |
| SG1214 | M129A D141A E143A D215A D315A L409A Y410G P411I A486V | −8.10 | 20.40 | 12.02 | — |
| SG1215 | M129A D141A E143A D215A L409A Y410G P411I A486V | −24.30 | 19.50 | 3.23 | — |
| SG1216 | M129A D141A E143A D315A L409A Y410G P411I A486V | −27.70 | 16.30 | 1.19 | — |
| SG1217 | M129A D141A E143A L409A Y410G P411I A486L | −30.70 | 5.80 | −0.05 | — |
| SG1220 | M129A D141A E143A T144A L409A Y410A P411I A486V | −29.50 | −2.30 | 4.19 | — |
| SG1227 | M129A D141A E143A L409A Y410A P411I A486V T515S | −41.50 | −5.50 | −4.41 | — |
| SG1229 | M129A D141A E143A L409A Y410A P411I A486V T590I | −38.70 | 0.70 | 0.65 | — |
| SG1235 | M129A D141A E143A L409A Y410A P411I A486V D215A | −15.50 | −0.20 | 3.91 | — |
| SG1236 | M129A D141A E143A L409A Y410A P411I A486V D315A | −12.80 | 0.30 | 1.53 | — |
| SG1237 | M129A D141A E143A L409A Y410A P411I A486V D215A D315A | −2.00 | 0.50 | 2.69 | — |
| SG1243 | M129A D141A E143A T144A L409A Y410G P411I A486V T515S | −46.40 | −4.40 | −0.39 | — |
| SG1245 | M129A D141A E143A T144A L409A | −32.70 | 10.10 | 0.57 | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| | Y410G | | | | |
| | P411I | | | | |
| | A486V | | | | |
| | T590I | | | | |
| SG1247 | M129A | −48.50 | −1.70 | −1.64 | — |
| | D141A | | | | |
| | E143A | | | | |
| | L409A | | | | |
| | Y410G | | | | |
| | P411I | | | | |
| | A486V | | | | |
| | T515S | | | | |
| | T590I | | | | |
| SG1250 | M129A | −17.70 | 11.00 | 5.56 | — |
| | D141A | | | | |
| | E143A | | | | |
| | T144A | | | | |
| | L409A | | | | |
| | Y410G | | | | |
| | P411I | | | | |
| | A486V | | | | |
| SG1251 | M129A | −38.90 | −1.20 | −2.96 | — |
| | D141A | | | | |
| | E143A | | | | |
| | L409A | | | | |
| | Y410G | | | | |
| | P411I | | | | |
| | A486V | | | | |
| | T515S | | | | |
| SG1253 | M129A | −23.80 | 14.40 | −2.39 | — |
| | D141A | | | | |
| | D143A | | | | |
| | L409A | | | | |
| | Y410G | | | | |
| | P411I | | | | |
| | A486V | | | | |
| | T590I | | | | |
| SG1257 | M129A | −26.70 | 10.70 | 0.55 | — |
| | D141A | | | | |
| | E143A | | | | |
| | L409A | | | | |
| | Y410G | | | | |
| | P411I | | | | |
| | A486V | | | | |
| | A639V | | | | |
| SG1262 | M129A | −48.50 | −5.50 | 5.08 | — |
| | D141A | | | | |
| | E143A | | | | |
| | T144A | | | | |
| | D215A | | | | |
| | D315A | | | | |
| | L409A | | | | |
| | Y410A | | | | |
| | P411I | | | | |
| | A486V | | | | |
| | T515S | | | | |
| SG1264 | M129A | −31.00 | −0.30 | 3.92 | — |
| | D141A | | | | |
| | E143A | | | | |
| | T144A | | | | |
| | D215A | | | | |
| | D315A | | | | |
| | L409A | | | | |
| | Y410A | | | | |
| | P411I | | | | |
| | A486V | | | | |
| | T590I | | | | |
| SG1266 | M129A | −31.10 | −0.80 | 0.08 | — |
| | D141A | | | | |
| | E143A | | | | |
| | D215A | | | | |
| | D315A | | | | |
| | L409A | | | | |
| | Y410A | | | | |
| | P411I | | | | |
| | A486V | | | | |
| | T515S | | | | |
| | T590I | | | | |
| SG1326 | D141A | — | — | — | — |
| | E143A | | | | |
| | T144A | | | | |
| | L409S | | | | |
| | Y410A | | | | |
| | P411V | | | | |
| | A486V | | | | |
| | T515S | | | | |
| | T590I | | | | |
| | G153E | | | | |
| SG1327 | D141A | — | — | — | — |
| | E143A | | | | |
| | T144A | | | | |
| | L409S | | | | |
| | Y410A | | | | |
| | P411V | | | | |
| | A486V | | | | |
| | T515S | | | | |
| | T590I | | | | |
| | K712E | | | | |
| SG1328 | D141A | — | — | — | — |
| | E143A | | | | |
| | T144A | | | | |
| | L409S | | | | |
| | Y410A | | | | |
| | P411V | | | | |
| | A486V | | | | |
| | T515S | | | | |
| | T590I | | | | |
| | I522L | | | | |
| SG1329 | D141A | — | — | — | — |
| | E143A | | | | |
| | T144A | | | | |
| | L409S | | | | |
| | Y410A | | | | |
| | P411V | | | | |
| | A486L | | | | |
| | T515S | | | | |
| | T590I | | | | |
| SG1330 | D141A | — | — | — | — |
| | E143A | | | | |
| | T144A | | | | |
| | L409S | | | | |
| | Y410A | | | | |
| | P411V | | | | |
| | A486V | | | | |
| | T515S | | | | |
| | T590I | | | | |
| | K602A | | | | |
| SG1331 | D141A | — | — | — | — |
| | E143A | | | | |
| | T144A | | | | |
| | L409S | | | | |
| | Y410A | | | | |
| | P411V | | | | |
| | A486V | | | | |
| | T515S | | | | |
| | T590I | | | | |
| | N735A | | | | |
| SG1332 | D141A | — | — | — | — |
| | E143A | | | | |
| | T144A | | | | |
| | L409S | | | | |
| | Y410A | | | | |
| | P411V | | | | |
| | A486V | | | | |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1333 | T515S T590I K477A D141A E143A T144A L409S Y410A P411V A486V T515S T590I K478A | — | — | — | — |
| SG1334 | D141A E143A T144A L409S Y410A P411V A486V T515S T590I L479S | — | — | — | — |
| SG1335 | D141A E143A T144A L409S Y410A P411V A486V T515S T590I K477A K478A L479S | — | — | — | — |
| SG1336 | D141A E143A T144A L409S Y410A P411V A486V T515S T590I A639L | — | — | — | — |
| SG1337 | D141A E143A T144A L409S Y410A P411V A486V T515S T590I R705A | — | — | — | — |
| SG1338 | D141A E143A T144A L409S Y410A P411V A486V T515S T590I E718A | — | — | — | — |
| SG1339 | D141A E143A T144A L409S Y410A P411V A486V | | | | |
| SG1340 | T515S T590I R713A D141A E143A T144A L409S Y410A P411V A486V T515S T590I D215A | — | — | — | — |
| SG1341 | D141A E143A T144A L409S Y410A P411V A486V T515S T590I D315A | — | — | — | — |
| SG1342 | D141A E143A T144A L409S Y410A P411V A486V T515S T590I D215A D315A | — | — | — | — |
| SG1343 | D141A E143A T144A L409S Y410A A486V T515S T590I G153E | — | — | — | — |
| SG1344 | D141A E143A T144A L409S Y410A A486V T515S T590I K712E | — | — | — | — |
| SG1345 | D141A E143A T144A L409S Y410A A486V T515S T590I I522L | — | — | — | — |
| SG1346 | D141A E143A T144A L409S Y410A A486L T515S T590I | — | — | — | — |
| SG1347 | D141A E143A T144A | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| | L409S<br>Y410A<br>A486V<br>T515S<br>T590I<br>K602A | | | | |
| SG1348 | D141A<br>E143A<br>T144A<br>L409S<br>Y410A<br>A486V<br>T515S<br>T590I<br>N735A | — | — | — | — |
| SG1349 | D141A<br>E143A<br>T144A<br>L409S<br>Y410A<br>A486V<br>T515S<br>T590I<br>K477A | — | — | — | — |
| SG1350 | D141A<br>E143A<br>T144A<br>L409S<br>Y410A<br>A486V<br>T515S<br>T590I<br>K478A | — | — | — | — |
| SG1351 | D141A<br>E143A<br>T144A<br>L409S<br>Y410A<br>A486V<br>T515S<br>T590I<br>L479S | — | — | — | — |
| SG1352 | D141A<br>E143A<br>T144A<br>L409S<br>Y410A<br>A486V<br>T515S<br>T590I<br>K477A<br>K478A<br>L479S | — | — | — | — |
| SG1353 | D141A<br>E143A<br>T144A<br>L409S<br>Y410A<br>A486V<br>T515S<br>T590I<br>A639L | — | — | — | — |
| SG1354 | D141A<br>E143A<br>T144A<br>L409S<br>Y410A<br>A486V<br>T515S<br>T590I<br>R705A | — | — | — | — |
| SG1355 | D141A<br>E143A<br>T144A<br>L409S<br>Y410A<br>A486V<br>T515S<br>T590I<br>E718A | — | — | — | — |
| SG1356 | D141A<br>E143A<br>T144A<br>L409S<br>Y410A<br>A486V<br>T515S<br>T590I<br>R713A | — | — | — | — |
| SG1357 | D141A<br>E143A<br>T144A<br>L409S<br>Y410A<br>A486V<br>T515S<br>T590I<br>D215A | — | — | — | — |
| SG1358 | D141A<br>E143A<br>T144A<br>L409S<br>Y410A<br>A486V<br>T515S<br>T590I<br>D315A | — | — | — | — |
| SG1359 | D141A<br>E143A<br>T144A<br>L409S<br>Y410A<br>A486V<br>T515S<br>T590I<br>D215A<br>D315A | — | — | — | — |
| SG1408 | M129A<br>D141A<br>T144A<br>E143A<br>L409A<br>Y410G<br>P411I<br>A486V<br>T515S<br>T590I | −48.00 | −3.70 | 1.24 | — |
| SG1412 | M129A<br>D141A<br>T144A<br>E143A<br>L409A<br>Y410G<br>P411I<br>A486V<br>T515S<br>K477M | −41.90 | −0.90 | — | — |
| SG1415 | M129A<br>D141A<br>T144A<br>E143A<br>L409A<br>Y410G | −47.90 | −4.40 | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
|  | P411I |  |  |  |  |
|  | A486V |  |  |  |  |
|  | T515S |  |  |  |  |
|  | K477W |  |  |  |  |
| SG1418 | M129A | −55.90 | −7.60 | — | — |
|  | D141A |  |  |  |  |
|  | T144A |  |  |  |  |
|  | E143A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | G153E |  |  |  |  |
| SG1419 | M129A | −42.00 | 6.80 | — | — |
|  | D141A |  |  |  |  |
|  | T144A |  |  |  |  |
|  | E143A |  |  |  |  |
|  | L409A |  |  |  |  |
|  | Y410G |  |  |  |  |
|  | P411I |  |  |  |  |
|  | A486V |  |  |  |  |
|  | I522L |  |  |  |  |
|  | G153E |  |  |  |  |
| SG1420 | M129A | −49.20 | 0.20 | — | — |
|  | D141A |  |  |  |  |
|  | E143A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | I522L |  |  |  |  |
|  | G153E |  |  |  |  |
| SG1424 | M129A | −51.30 | −3.40 | — | — |
|  | D141A |  |  |  |  |
|  | T144A |  |  |  |  |
|  | E143A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | K712E |  |  |  |  |
| SG1426 | M129A | −47.50 | 7.90 | — | — |
|  | D141A |  |  |  |  |
|  | E143A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | I522L |  |  |  |  |
|  | K712E |  |  |  |  |
| SG1429 | M129A | −43.80 | −4.00 | — | — |
|  | D141A |  |  |  |  |
|  | E143A |  |  |  |  |
|  | L409A |  |  |  |  |
|  | Y410G |  |  |  |  |
|  | P411I |  |  |  |  |
|  | T515A |  |  |  |  |
|  | A486V |  |  |  |  |
| SG1433 | M129A | −34.50 | 16.40 | 4.38 | — |
|  | D141A |  |  |  |  |
|  | E143A |  |  |  |  |
|  | L409A |  |  |  |  |
|  | Y410G |  |  |  |  |
|  | P411I |  |  |  |  |
|  | T590S |  |  |  |  |
|  | A486V |  |  |  |  |
| SG1441 | M129A | −57.80 | −7.20 | — | — |
|  | D141A |  |  |  |  |
|  | T144A |  |  |  |  |
|  | E143A |  |  |  |  |
|  | L409A |  |  |  |  |
|  | Y410G |  |  |  |  |
|  | A486V |  |  |  |  |
|  | T515S |  |  |  |  |
|  | T590I |  |  |  |  |
| SG1442 | M129A | — | — | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | I522L |  |  |  |  |
| SG1445 | M129A | — | — | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590S |  |  |  |  |
| SG1452 | M129A | — | — | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
| SG1453 | M129A | — | — | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | K477A |  |  |  |  |
| SG1455 | M129A | — | — | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | K478A |  |  |  |  |
| SG1457 | M129A | −23.50 | 8.80 | — | — |
|  | D141A |  |  |  |  |
|  | E143A |  |  |  |  |
|  | T144A |  |  |  |  |
|  | L409A |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | L479A |  |  |  |  |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1457 | M129A D141A E143A T144A L409A Y410G P411I A486V T515S T590I L479A | −23.50 | 8.80 | — | — |
| SG1458 | M129A D141A E143A T144A L409A Y410G P411I A486V T515S T590I L479S | −33.60 | 1.80 | — | — |
| SG1459 | M129A D141A E143A T144A L409A Y410G P411I A486V T515S T590I A639V | −36.00 | −3.00 | — | — |
| SG1460 | M129A D141A E143A T144A L409A Y410G P411I A486V T515S T590I A639L | −46.10 | −4.20 | — | — |
| SG1461 | M129A D141A E143A T144A L409A Y410G P411I A486V T515S T590I R705A | −47.20 | −3.60 | — | — |
| SG1462 | M129A D141A E143A T144A L409A Y410G P411I A486V T515S T590I R713A | −41.70 | 3.50 | — | — |
| SG1463 | M129A D141A E143A T144A L409A Y410G P411I A486V T515S T590I E718N | −46.40 | −3.40 | — | — |
| SG1464 | M129A D141A E143A T144A L409A Y410G P411I A486V T515S T590I E718A | −43.80 | −1.70 | — | — |
| SG1465 | M129A D141A E143A T144A L409A Y410G P411I A486V T515S T590I K602A | — | — | — | — |
| SG1494 | M129A D141A E143A T144A L409A Y410G P411I A486V T515S T590I G153E K712E | — | — | — | — |
| SG1495 | M129A D141A E143A T144A L409A Y410G P411I A486V T515S T590I G153E I522L | — | — | — | — |
| SG1496 | M129A D141A E143A T144A L409A Y410G P411I A486L T515S T590I G153E | — | — | — | — |
| SG1497 | M129A D141A E143A T144A L409A Y410G P411I A486V T515S T590I | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1498 | G153E<br>K602A<br>M129A<br>D141A<br>E143A<br>T144A<br>L409A<br>Y410G<br>P411I<br>A486V<br>T515S<br>T590I | — | — | — | — |
| SG1499 | G153E<br>N735A<br>M129A<br>D141A<br>E143A<br>T144A<br>L409A<br>Y410G<br>P411I<br>A486V<br>T515S<br>T590I | — | — | — | — |
| SG1600 | G153E<br>K477A<br>M129A<br>D141A<br>E143A<br>T144A<br>L409A<br>Y410G<br>P411I<br>A486V<br>T515S<br>T590I | — | — | — | — |
| SG1601 | G153E<br>K478A<br>M129A<br>D141A<br>E143A<br>T144A<br>L409A<br>Y410G<br>P411I<br>A486V<br>T515S<br>T590I | — | — | — | — |
| SG1602 | G153E<br>L479S<br>M129A<br>D141A<br>E143A<br>T144A<br>L409A<br>Y410G<br>P411I<br>A486V<br>T515S<br>T590I | — | — | — | — |
| SG1603 | G153E<br>K477A<br>K478A<br>L479S<br>M129A<br>D141A<br>E143A<br>T144A<br>L409A<br>Y410G<br>P411I<br>A486V<br>T515S<br>T590I | — | — | — | — |
| SG1604 | G153E<br>A639L<br>M129A<br>D141A<br>E143A<br>T144A<br>L409A<br>Y410G<br>P411I<br>A486V<br>T515S<br>T590I | — | — | — | — |
| SG1605 | G153E<br>R705A<br>M129A<br>D141A<br>E143A<br>T144A<br>L409A<br>Y410G<br>P411I<br>A486V<br>T515S<br>T590I | — | — | — | — |
| SG1606 | G153E<br>E718A<br>M129A<br>D141A<br>E143A<br>T144A<br>L409A<br>Y410G<br>P411I<br>A486V<br>T515S<br>T590I | — | — | — | — |
| SG1607 | G153E<br>R713A<br>M129A<br>D141A<br>E143A<br>T144A<br>L409A<br>Y410G<br>P411I<br>A486V<br>T515S<br>T590I | — | — | — | — |
| SG1608 | G153E<br>D215A<br>M129A<br>D141A<br>E143A<br>T144A<br>L409A<br>Y410G<br>P411I<br>A486V<br>T515S<br>T590I | — | — | — | — |
| SG1609 | G153E<br>D315A<br>M129A<br>D141A<br>E143A<br>T144A<br>L409A<br>Y410G<br>P411I<br>A486V | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1610 | T515S T590I G153E D215A D315A M129A D141A E143A T144A L409A Y410G P411I A486V T515S T590I G153E K712E I522I | — | — | — | — |
| SG1611 | M129A D141A E143A T144A L409A Y410G P411I A486L T515S T590I G153E K712E | — | — | — | — |
| SG1612 | M129A D141A E143A T144A L409A Y410G P411I A486V T515S T590I G153E K712E K602A | — | — | — | — |
| SG1613 | M129A D141A E143A T144A L409A Y410G P411I A486V T515S T590I G153E K712E N735A | — | — | — | — |
| SG1614 | M129A D141A E143A T144A L409A Y410G P411I A486V T515S T590I G153E K712E K477A | — | — | — | — |
| SG1615 | M129A D141A E143A T144A L409A Y410G P411I A486V T515S T590I G153E K712E K478A | — | — | — | — |
| SG1616 | M129A D141A E143A T144A L409A Y410G P411I A486V T515S T590I G153E K712E L479S | — | — | — | — |
| SG1617 | M129A D141A E143A T144A L409A Y410G P411I A486V T515S T590I G153E K712E K477A K478A L479S | — | — | — | — |
| SG1618 | M129A D141A E143A T144A L409A Y410G P411I A486V T515S T590I G153E K712E A639L | — | — | — | — |
| SG1619 | M129A D141A E143A T144A L409A Y410G P411I A486V T515S T590I G153E K712E R705A | — | — | — | — |
| SG1620 | M129A D141A E143A T144A L409A Y410G P411I A486V | | | | |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1621 | T515S T590I G153E K712E E718A M129A D141A E143A T144A L409A Y410G P411I A486V T515S T590I G153E K712E R713A | — | — | — | — |
| SG1622 | M129A D141A E143A T144A L409A Y410G P411I A486V T515S T590I G153E K712E D215A | — | — | — | — |
| SG1623 | M129A D141A E143A T144A L409A Y410G P411I A486V T515S T590I G153E K712E D315A | — | — | — | — |
| SG1624 | M129A D141A E143A T144A L409A Y410G P411I A486V T515S T590I G153E K712E D215A D315A | — | — | — | — |
| SG1625 | M129A D141A T144A E143A L409A Y410G A486V T515S T590I G153E | — | — | — | — |
| SG1626 | M129A D141A T144A E143A L409A Y410G A486V T515S T590I G153E K712E | — | — | — | — |
| SG1627 | M129A D141A E143A T144A L409A Y410G A486V T515S T590I G153E I522I | — | — | — | — |
| SG1628 | M129A D141A E143A T144A L409A Y410G A486L T515S T590I G153E | — | — | — | — |
| SG1629 | M129A D141A E143A T144A L409A Y410G A486V T515S T590I G153E K602A | — | — | — | — |
| SG1630 | M129A D141A E143A T144A L409A Y410G A486V T515S T590I G153E N735A | — | — | — | — |
| SG1631 | M129A D141A E143A T144A L409A Y410G A486V T515S T590I G153E K477A | — | — | — | — |
| SG1632 | M129A D141A E143A T144A L409A Y410G A486V T515S T590I G153E K478A | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1633 | M129A D141A E143A T144A L409A Y410G A486V T515S T590I G153E L479S | — | — | — | — |
| SG1634 | M129A D141A E143A T144A L409A Y410G A486V T515S T590I G153E K477A K478A L479S | — | — | — | — |
| SG1635 | M129A D141A E143A T144A L409A Y410G A486V T515S T590I G153E A639L | — | — | — | — |
| SG1636 | M129A D141A E143A T144A L409A Y410G A486V T515S T590I G153E R705A | — | — | — | — |
| SG1637 | M129A D141A E143A T144A L409A Y410G A486V T515S T590I G153E E718A | — | — | — | — |
| SG1638 | M129A D141A E143A T144A L409A Y410G A486V T515S T590I G153E R713A | — | — | — | — |
| SG1639 | M129A D141A E143A T144A L409A Y410G A486V T515S T590I G153E D215A | — | — | — | — |
| SG1640 | M129A D141A E143A T144A L409A Y410G A486V T515S T590I G153E D315A | — | — | — | — |
| SG1641 | M129A D141A E143A T144A L409A Y410G A486V T515S T590I G153E D215A D315A | — | — | — | — |
| SG1642 | M129A D141A E143A T144A L409A Y410G A486V T515S T590I G153E K712E i522I | — | — | — | — |
| SG1643 | M129A D141A E143A T144A L409A Y410G A486L T515S T590I G153E K712E | — | — | — | — |
| SG1644 | M129A D141A E143A T144A L409A Y410G A486V T515S T590I G153E K712E K602A | — | — | — | — |
| SG1645 | M129A D141A E143A T144A L409A Y410G A486V | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| | T515S | | | | |
| | T590I | | | | |
| | G153E | | | | |
| | K712E | | | | |
| | N735A | | | | |
| SG1646 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | K477A | | | | |
| SG1647 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | K478A | | | | |
| SG1648 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | L479S | | | | |
| SG1649 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | K477A | | | | |
| | K478A | | | | |
| | L479S | | | | |
| SG1650 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | A639L | | | | |
| SG1651 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | R705A | | | | |
| SG1652 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | E718A | | | | |
| SG1653 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | R713A | | | | |
| SG1654 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | D215A | | | | |
| SG1655 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | D315A | | | | |
| SG1656 | M129A | — | — | — | — |
| | D141A | | | | |
| | E143A | | | | |
| | T144A | | | | |
| | L409A | | | | |
| | Y410G | | | | |
| | A486V | | | | |
| | T515S | | | | |
| | T590I | | | | |
| | G153E | | | | |
| | K712E | | | | |
| | D215A | | | | |
| | D315A | | | | |
| SG1657 | M129A | — | — | — | — |
| | D141A | | | | |
| | E143A | | | | |
| | T144A | | | | |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
| SG1658 | L409S Y410G P411I A486V T515S T590I G153E M129A D141A E143A T144A L409S Y410G P411I A486V T515S T590I G153E K712E | — | — | — | — |
| SG1659 | M129A D141A E143A T144A L409S Y410G P411I A486V T515S T590I G153E I522L | — | — | — | — |
| SG1660 | M129A D141A E143A T144A L409S Y410G P411I A486L T515S T590I G153E | — | — | — | — |
| SG1661 | M129A D141A E143A T144A L409S Y410G P411I A486V T515S T590I G153E K602A | — | — | — | — |
| SG1662 | M129A D141A E143A T144A L409S Y410G P411I A486V T515S T590I G153E N735A | — | — | — | — |
| SG1663 | M129A D141A E143A T144A L409S Y410G P411I A486V T515S T590I G153E K477A | — | — | — | — |
| SG1664 | M129A D141A E143A T144A L409S Y410G P411I A486V T515S T590I G153E K478A | — | — | — | — |
| SG1665 | M129A D141A E143A T144A L409S Y410G P411I A486V T515S T590I G153E L479S | — | — | — | — |
| SG1666 | M129A D141A E143A T144A L409S Y410G P411I A486V T515S T590I G153E K477A K478A L479S | — | — | — | — |
| SG1667 | M129A D141A E143A T144A L409S Y410G P411I A486V T515S T590I G153E A639L | — | — | — | — |
| SG1668 | M129A D141A E143A T144A L409S Y410G P411I A486V T515S T590I G153E R705A | — | — | — | — |
| SG1669 | M129A D141A E143A T144A | — | — | — | — |

TABLE 8-continued

Relative average half time for reversible moieties for mutant variants.

| Variant | Mutations | Relative half time i-term1 (s) | Relative half time i-term2 (s) | Relative half time S-term (s) | Relative half time A-term (s) |
|---|---|---|---|---|---|
|  | L409S |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
|  | E718A |  |  |  |  |
| SG1670 | M129A | — | — | — | — |
|  | D141A |  |  |  |  |
|  | E143A |  |  |  |  |
|  | T144A |  |  |  |  |
|  | L409S |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
|  | R713A |  |  |  |  |
| SG1671 | M129A | — | — | — | — |
|  | D141A |  |  |  |  |
|  | E143A |  |  |  |  |
|  | T144A |  |  |  |  |
|  | L409S |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
|  | D215A |  |  |  |  |
| SG1672 | M129A | — | — | — | — |
|  | D141A |  |  |  |  |
|  | E143A |  |  |  |  |
|  | T144A |  |  |  |  |
|  | L409S |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
|  | D315A |  |  |  |  |
| SG1673 | M129A | — | — | — | — |
|  | D141A |  |  |  |  |
|  | E143A |  |  |  |  |
|  | T144A |  |  |  |  |
|  | L409S |  |  |  |  |
|  | Y410G |  |  |  |  |
|  | P411I |  |  |  |  |
|  | A486V |  |  |  |  |
|  | T515S |  |  |  |  |
|  | T590I |  |  |  |  |
|  | G153E |  |  |  |  |
|  | D215A |  |  |  |  |
|  | D315A |  |  |  |  |

REFERENCES

1. Carl W. Fuller. November 2011. *Nature BioTechnology.*
2. Stanley Tabor and Charles C. Richardson, April 1989. *Journal of Biological Chemistry.*
3. Steven J. Evans and Mark J. Fogg et al., 2000. *Oxford University Press.*
4. Andrew F. Gardner and William E. Jack, 1997. *Nucleic Acids Research.* Vol. 27 No. 3
5. Diana C. Knapp et al., 2011. *Chem. Eur. J.* 17.
6. Michael L. Metzker et al., Jul. 25, 1994. *Oxford University Press.*
7. Bruno Canard and Robert S. Sarfati, 1994. *Elsevier Science B. V.*
8. Bruno Canard, Bruno Cardona, and Robert S. Sarfati, November 1995. *Proc. Natl. Acad. Sci.* USA.
9. Mike B. Welch and Kevin Burgess, 1999. *Nucleosides & Nucleotides.*
10. Mike B. Welch and Carlos I. Martinez et al., 1999. *Chem, Eur. J.* No. 3.
11. Jingyue Ju and Dae Hyun Kim et al., Oct. 26, 2006. *Columbia Genome Center.*
12. Taek-Soo Kim and Da-Rae Kim et al., 2010. *ChemBioChem* Volume 11.
13. Jia Guo and Ning Xu et al., Apr. 28, 2008. *Columbia Genome Center.*
    a. Published Application [Ju et al.] U.S. Pat. No. 6,664,079. Dec. 16, 2003.
    b. Supporting Information [Guo et al.]. *PNAS.*
14. Jia Guo and Lin Yu et al., Apr. 20, 2010. *NIH-PA.*
15. Bentley et al. *NATURE.* Volume 456. 6 Nov. 2008.
    a. Supplement to Bentley et al. *NATURE.* Volume 456. 6 Nov. 2008.
16. [Milton et al.] U.S. Pat. No. 7,541,444B2. Jun. 6, 2009.
17. Fei Chen and Eric A. Gaucher, Dec. 1, 2009. *PANS.*
18. Foldesi and Keller, 2007. *Nucleosides, Nucleotides, and Nucleic Acids,* Volume 26.
19. [Kwiatowski] U.S. Pat. No. 6,255,475B1. Jul. 3, 2001.
20. Jian Wu and Shenglong Zhang, Aug. 10, 2007. *PNAS.*
21. Hameer Ruparel and Lanrong Bi, Mar. 10, 2005. *PNAS.*
22. Jonathan Filee et al., 27 Nov. 2001. *Journal of Molecular Evolution.*
23. Diana C. Knapp et al., 2011. *Chem. Eur.*
24. Georges N. Cohen et al., 2003. *Molecular Microbiology,* Volume 47.
25. Yannick Gueguen et al., 2001. *Eur. J Biochem.*
26. Sonoko Ishino and Yoshizumi Ishino, 29 Aug. 2014. *Frontiers in Microbiology.*
27. Jack et al. Patent US2006/0199214-A1. Sep. 7, 2006.
28. Perler et al. U.S. Pat. No. 5,756,334. May 26, 1998.
29. Allen Horhota et al., Nov. 29, 2004. *JACS Articles.*
30. Andrew F. Gardner and William E. Jack, Oct. 31, 2001. *Oxford University Press.*
31. Jacques Dietrich et al., 22 Oct. 2002. *FEMS Microbiology Letters.*
32. Nikiforov T T. et al. *Anal Biochem.* 2014 Sep. 15; 461:67-73
33. Nikiforov T T. et al. *Anal Biochem.* 2011 May 15; 412(2):229-36.

P-EMBODIMENTS

Embodiment P-1. A polymerase comprising an amino acid sequence that is at least 80% identical to a continuous 500 amino acid sequence within SEQ ID NO: 1, wherein the exonuclease activity of the polymerase is reduced at least 80% relative to the exonuclease activity of a polymerase of SEQ ID NO: 1.

Embodiment P-2 The polymerase of Embodiment P-1, wherein the polymerase comprises an amino acid sequence that is at least 95% identical to a continuous 500 amino acid sequence within SEQ ID NO: 1.

Embodiment P-3. The polymerase of Embodiment P-1, wherein the polymerase comprises an amino acid sequence that is at least 80% identical to a continuous 700 amino acid sequence within SEQ ID NO: 1.

Embodiment P-4. The polymerase of Embodiment P-3, wherein the polymerase comprises an amino acid sequence that is at least 95% identical to a continuous 700 amino acid sequence within SEQ ID NO: 1.

Embodiment P-5. The polymerase of one of Embodiment P-1 to Embodiment P-4, wherein the reduction in exonuclease activity of the polymerase results from one or more amino acid mutations in SEQ ID NO: 1.

Embodiment P-6. The polymerase of one of Embodiment P-1 to Embodiment P-5, wherein the polymerase comprises an amino acid substitution mutation between position 129 and 316 of SEQ ID NO: 1, inclusive of position endpoints.

Embodiment P-7. The polymerase of one of Embodiment P-1 to Embodiment P-6, wherein the polymerase comprises an amino acid substitution mutation at position 129, 141, 143, 144, 209, 210, 213, 214, 215, 274, 275, 311 and/or 315 of SEQ ID NO: 1.

Embodiment P-8. The polymerase of one of Embodiment P-1 to Embodiment P-7, wherein the polymerase comprises an alanine substitution mutation at position 141 and/or 143 of SEQ ID NO: 1.

Embodiment P-9. The polymerase of one of Embodiment P-1 to Embodiment P-8, wherein the polymerase activity of the polymerase is altered relative to the polymerase activity of a polymerase of SEQ ID NO: 1.

Embodiment P-10. The polymerase of Embodiment P-9, wherein the altered polymerase activity of the polymerase results from one or more amino acid mutations in SEQ ID NO: 1, and wherein the altered polymerase activity is the capability of incorporating modified nucleotides during nucleic acid synthesis.

Embodiment P-11. The polymerase of one of Embodiment P-1 to Embodiment P-10, wherein the polymerase comprises an amino acid substitution mutation after position 390 of SEQ ID NO: 1, inclusive of position endpoints.

Embodiment P-12. The polymerase of one of Embodiment P-1 to Embodiment P-11, where the polymerase comprises an amino acid substitution mutation at position 405, 408, 409, 410, 411, 484, 486, 488, 492, 495, 496, 497, 540, 542, and/or 543 of SEQ ID NO: 1.

Embodiment P-13. The polymerase of one of Embodiment P-1 to Embodiment P-12, wherein the polymerase comprises substitution mutations at position 129, 141, 143, 409, 410, 411, and/or 486 of SEQ ID NO: 1.

Embodiment P-14. The polymerase of Embodiment P-13 wherein the amino acid substitution mutation at position 129 is an alanine substitution, a glycine substitution, a valine substitution, a leucine substitution, or an isoleucine substitution; the amino acid substitution mutation at position 141 is an alanine substitution, a glycine substitution, a valine substitution, a methionine substitution, a leucine substitution, or an isoleucine substitution; the amino acid substitution mutation at position 143 is an alanine substitution, a glycine substitution, a valine substitution, a methionine substitution, a leucine substitution, or an isoleucine substitution; the amino acid substitution at position 409 is a serine substitution, a threonine substitution, an asparagine substitution, a glutamine substitution, alanine substitution, a glycine substitution, a valine substitution, a methionine substitution, a leucine substitution, or an isoleucine substitution; the amino acid substitution at position 410 is an alanine substitution, a glycine substitution, a valine substitution, a methionine substitution, a leucine substitution, or an isoleucine substitution; the amino acid substitution at position 411 is an alanine substitution, a glycine substitution, an isoleucine substitution, a leucine substitution, a methionine substitution, or a valine substitution; the amino acid substitution at position 486 an alanine substitution, a glycine substitution, an isoleucine substitution, a leucine substitution, a methionine substitution, or a valine substitution.

Embodiment P-15. The polymerase of one of Embodiment P-1 to Embodiment P-14, wherein the amino acid substitution mutation is an alanine at position 129, an alanine at position 141, an alanine at position 143, a serine at position 409, alanine at position 409, an alanine at position 410, a valine at position 411, an isoleucine at position 411, and/or a valine at position 486.

Embodiment P-16. The polymerase of one of Embodiment P-1 to Embodiment P-15, wherein the polymerase comprises an alanine at position 141, an alanine at position 143, serine at position 409, an alanine at position 410, and a valine at position 411.

Embodiment P-17. The polymerase of one of Embodiment P-1 to Embodiment P-16, wherein the polymerase comprises an alanine at position 141, an alanine at position 143, a serine at position 409, an alanine at position 410, a valine at position 411 and a valine at position 486.

Embodiment P-18 The polymerase of one of Embodiment P-1 to Embodiment P-17, wherein the polymerase comprises an alanine at position 129, an alanine at position 141, an alanine at position 143, an alanine at position 409, an alanine at position 410, an isoleucine at position 411 and a valine at position 486.

Embodiment P-19. The polymerase of one of Embodiment P-1 to Embodiment P-18 wherein the exonuclease activity of the polymerase is reduced at least 90% relative to the exonuclease activity of a polymerase of SEQ ID NO: 1.

Embodiment P-20. The polymerase of one of Embodiment P-1 to Embodiment P-19 wherein the exonuclease activity of the polymerase is reduced at least 99% relative to the exonuclease activity of a polymerase of SEQ ID NO: 1.

Embodiment P-21. A method of incorporating a modified nucleotide into a nucleic acid sequence comprising allowing the following components to interact: (i) a DNA template, (ii) a nucleotide solution, and (iii) a polymerase, wherein the polymerase comprises an amino acid sequence that is at least 80% identical to a continuous 500 amino acid sequence within SEQ 1, and wherein the exonuclease activity of the polymerase is reduced at least 80% relative to the exonuclease activity of a polymerase of SEQ ID NO: 1.

Embodiment P-22. The method of Embodiment P-21, wherein the reduction in exonuclease activity of the polymerase results from one or more amino acid mutations in SEQ ID NO: 1.

Embodiment P-23. The method of one of Embodiment P-21 and Embodiment P-22, wherein the polymerase activity of the polymerase is altered relative to the polymerase activity of a polymerase of SEQ ID NO: 1.

Embodiment P-24. The method of one of Embodiment P-21 to Embodiment P-23, wherein the altered polymerase activity of the polymerase results from one or more amino acid mutations in SEQ ID NO: 1, and wherein the altered polymerase activity is the capability of incorporating modified nucleotides during nucleic acid synthesis.

Embodiment P-25. The method of one of Embodiment P-21 to Embodiment P-24, wherein the polymerase comprises substitution mutations at position 129, 141, 143, 409, 410, 411, and/or 486 of SEQ ID NO: 1.

Embodiment P-26. The method of one of Embodiment P-21 to Embodiment P-25, wherein the polymerase comprises an alanine at position 141, an alanine at position 143, serine at position 409, an alanine at position 410, and a valine at position 411.

Embodiment P-27. The method of one of Embodiment P-21 to Embodiment P-25, wherein the polymerase comprises an alanine at position 141, an alanine at position 143, a serine at position 409, an alanine at position 410, a valine at position 411 and a valine at position 486.

Embodiment P-28. The method of one of Embodiment P-21 to Embodiment P-25, wherein the polymerase comprises an alanine at position 129, an alanine at position 141, an alanine at position 143, an alanine at position 409, an alanine at position 410, an isoleucine at position 411 and a valine at position 486.

ADDITIONAL EMBODIMENTS

Embodiment 1

A polymerase comprising an amino acid sequence that is at least 80% identical to a continuous 500 amino acid sequence within SEQ ID NO: 1; comprising the following amino acids:
an alanine, serine, or histidine, at amino acid position 409 or any amino acid that is functionally equivalent to the amino acid position 409;
a glycine or alanine at amino acid position 410 or any amino acid that is functionally equivalent to the amino acid position 410; and
a proline, valine, or isoleucine at amino acid position 411 or any amino acid that is functionally equivalent to the amino acid position 411.

Embodiment 2

The polymerase of Embodiment 1, wherein the polymerase comprises an amino acid sequence that is at least 95% identical to a continuous 500 amino acid sequence within SEQ ID NO: 1.

Embodiment 3

The polymerase of Embodiments 1 or 2, wherein the polymerase comprises an alanine at amino acid position 409; an alanine or glycine at amino acid position 410; and an isoleucine, or proline at amino acid position 411.

Embodiment 4

The polymerase of Embodiments 1 or 2, wherein the polymerase comprises an alanine at amino acid position 409; a glycine at amino acid position 410; and an isoleucine or proline at amino acid position 411.

Embodiment 5

The polymerase of Embodiment 4, wherein the polymerase comprises an isoleucine at amino acid position 411.

Embodiment 6

The polymerase of Embodiments 1 or 2, wherein the polymerase comprises a serine at amino acid position 409; an alanine or glycine at amino acid position 410; and a valine, isoleucine, or proline at amino acid position 411.

Embodiment 7

The polymerase of Embodiments 1 or 2, wherein the polymerase comprises a serine at amino acid position 409; an alanine at amino acid position 410; and a valine, isoleucine, or proline at amino acid position 411.

Embodiment 8

The polymerase of any one of Embodiments 1 to 7, wherein the polymerase comprises an amino acid substitution mutation between position 129 and 316 of SEQ ID NO: 1, inclusive of position endpoints.

Embodiment 9

The polymerase of any one of Embodiments 1 to 7, wherein the polymerase comprises an amino acid substitution mutation at positions 129, 141, and 143.

Embodiment 10

The polymerase of any one of Embodiments 1 to 9, wherein the polymerase comprises an alanine substitution mutation at position 129.

Embodiment 11

The polymerase of any one of Embodiments 1 to 10, wherein the polymerase comprises an alanine substitution mutation at position 141.

Embodiment 12

The polymerase of any one of Embodiments 1 to 11, wherein the polymerase comprises an alanine substitution mutation at position 143.

Embodiment 13

The polymerase of any one of Embodiments 1 to 12, wherein the polymerase comprises an alanine substitution mutation at position 144.

Embodiment 14

The polymerase of any one of Embodiments 1 to 13, wherein the polymerase comprises a leucine or valine substitution mutation at position 486.

Embodiment 15

The polymerase of any one of Embodiments 1 to 14, wherein the polymerase comprises serine at position 515.

Embodiment 16

The polymerase of any one of Embodiments 1 to 15, wherein the polymerase comprises isoleucine at position 590.

Embodiment 17

A polymerase comprising an amino acid sequence that is at least 80% identical to a continuous 500 amino acid sequence within SEQ ID NO: 1; comprising the following mutations:
M129A, D141A, T144A, E143A, L409A, Y410G, A486V, T515S, and T590I;
M129A, D141A, T144A, E143A, L409A, Y410G, P411I, A486V, T515S, and G153E;

M129A, D141A, T144A, E143A, L409A, Y410G, P411I, A486V, T515S, and K712E;

M129A, D141A, E143A, L409A, Y410G, P411I, A486V, T515S, I522L, and G153E;

M129A, D141A, E143A, L409A, Y410G, P411, and A486V;

M129A, D141A, E143A, L409A, Y410G, P411I, A486V, T515S, and T590I;

M129A, D141A, E143A, T144A, D215A, D315A, L409A, Y410A, P411I, A486V, and T515S;

M129A, D141A, T144A, E143A, L409A, Y410G, P411I, A486V, T515S, and T590I;

M129A, D141A, T144A, E143A, L409A, Y410G, P411I, A486V, T515S, and K477W;

M129A, D141A, E143A, L409A, Y410G, P411I, A486V, T515S, I522L, and K712E;

M129A, D141A, E143A, T144A, L409A, Y410G, P411I, A486V, T515S, T590I, and R705A;

M129A, D141A, E143A, T144A, L409A, Y410G, P411I, A486V, and T515S;

M129A, D141A, E143A, T144A, L409A, Y410G, P411I, A486V, T515S, T590I, and E718N;

M129A, D141A, E143A, T144A, L409A, Y410G, P411I, A486V, T515S, T590I, and A639L;

M129A, D141A, E143A, L409A, Y410G, P411I, T515A, and A486V;

M129A, D141A, E143A, T144A, L409A, Y410G, P411I, A486V, T515S, T590I, and E718A;

M129A, D141A, T144A, E143A, L409A, Y410G, P411I, A486V, I522L, and G153E;

M129A, D141A, T144A, E143A, L409A, Y410G, P411I, A486V, T515S, and K478M;

M129A, D141A, E143A, T144A, L409A, Y410G, P411I, A486V, T515S, T590I, and R713A;

M129A, D141A, E143A, L409A, Y410A, P411I, A486V, and T515S;

M129A, D141A, E143A, L409S, Y410G, P411I, and A486V;

M129A, D141A, E143A, L409A, Y410G, P411I, A486V, and T515S;

M129A, D141A, E143A, L409A, Y410A, P411I, A486V, and T590I;

M129A, D141A, E143A, L409S, Y410G, P411S, and A486V;

M129A, D141A, E143A, T144A, L409A, Y410G, P411I, A486V, T515S, T590I, and A639V;

M129A, D141A, E143A, L409A, Y410G, P411V, and A486V;

M129A, D141A, E143A, L409A, Y410G, P411I, T590S, and A486V;

M129A, D141A, E143A, T144A, L409A, Y410G, P411I, A486V, T515S, T590I, and L479S;

M129A, D141A, E143A, T144A, L409A, Y410G, P411I, A486V, and T590I;

M129A, D141A, E143A, D215A, D315A, L409A, Y410A, P411I, A486V, T515S, and T590I;

M129A, D141A, E143A, T144A, D215A, D315A, L409A, Y410A, P411I, A486V, and T590I;

M129A, D141A, E143A, L409A, Y410G, P411I, and A486L;

M129A, D141A, E143A, T144A, L409A, Y410A, P411I, and A486V;

M129A, D141A, E143A, L409A, Y410G, P411G, and A486V;

M129A, D141A, E143A, D315A, L409A, Y410G, P411I, and A486V;

M129A, D141A, D143A, L409A, Y410G, P411I, A486V, and A639V;

M129A, D141A, E143A, L409Q, Y410A, P411I, and A486V;

M129A, D141A, E143A, D215A, L409A, Y410G, P411I, and A486V;

M129A, D141A, E143A, L409A, Y410G, P411I, A486V, and T590I;

M129A, D141A, E143A, T144A, L409A, Y410G, P411I, A486V, T515S, T590I, and L479A;

M129A, D141A, E143A, T144A, L409A, Y410G, P411I, A486V, T515S, T590I, and L479A;

M129A, D141A, E143A, T144A, L409A, Y410G, P411I, and A486V;

M129A, D141A, E143A, L409A, Y410A, P411I, A486V, and D215A;

M129A, D141A, E143A, L409A, Y410G, P411A, and A486V;

M129A, D141A, E143A, L409A, Y410A, P411I, A486V, and D315A;

M129A, D141A, E143A, D215A, D315A, L409A, Y410G, P411I, and A486V;

M129A, D141A, E143A, L409A, Y410G, P411T, and A486V; or

M129A, D141A, E143A, L409A, Y410A, P411I, A486V, D215A, and D315A.

Embodiment 18

A polymerase comprising an amino acid sequence that is at least 80% identical to a continuous 500 amino acid sequence within SEQ ID NO: 1; comprising the following mutations:

M129A, D141A, E143A, L409A, Y410G, P411, and A486V;

M129A, D141A, E143A, L409A, Y410G, P411V, and A486V;

M129A, D141A, E143A, L409A, Y410G, P411L, and A486V;

M129A, D141A, E143A, L409S, Y410G, P411I, and A486V;

M129A, D141A, E143A, L409H, Y410G, P411I, and A486V;

M129A, D141A, E143A, L409A, Y410G, P411G, and A486V;

M129A, D141A, E143A, L409A, Y410A, P411I, A486V, and T515S;

M129A, D141A, E143A, L409A, Y410G, P411S, and A486V;

M129A, D141A, E143A, L409A, Y410G, P411I, A486V, and T515S;

M129A, D141A, E143A, L409A, Y410G, P411T, and A486V;

M129A, D141A, D143A, L409A, Y410G, P411I, A486V, and T590I;

M129A, D141A, E143A, L409G, Y410G, P411I, and A486V;

M129A, D141A, E143A, L409A, Y410G, P411I, A486V, T515S, and T590I; or

M129A, D141A, E143A, L409A, Y410G, P411I, and A486L.

Embodiment 19

The polymerase of any one of Embodiments 1 to 18, which exhibits an increased rate of incorporation of modified nucleotides, relative to a wild-type *P. abyssi* DNA polymerase.

Embodiment 20

A method of incorporating a modified nucleotide into a nucleic acid sequence comprising allowing the following components to interact: (i) a DNA template, (ii) a nucleotide solution, and (iii) a polymerase, wherein the polymerase is a polymerase of any one of Embodiments 1 to 18.

Embodiment 21

The method of Embodiment 20, wherein the polymerase is capable of incorporating a modified nucleotide into a nucleic acid sequence in stringent hybridization conditions.

Embodiment 22

The method of Embodiment 20, wherein the polymerase is capable of incorporating a modified nucleotide into a nucleic acid sequence at 55 to 80 degrees Celsius.

Embodiment 23

The method of Embodiment 20, wherein the polymerase is capable of incorporating a modified nucleotide into a nucleic acid sequence at a pH of 8.0 to 11.0.

SEQUENCE LISTING (215 sequences)

SEQ ID NO: 1 - protein, 771 aa, Artificial sequence
  Synthetic polypeptide
  misc_feature: SG1000 (WT)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVDIETLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSLYPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 2 - protein, 771 aa, Artificial sequence
  Synthetic polypeptide
  misc_feature: SG1091 (exo)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSLYPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 3 - protein, 771 aa, Artificial sequence
  Synthetic polypeptide
  misc_feature: SG1200
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 4 - protein, 771 aa, Artificial sequence
  Synthetic polypeptide
  misc_feature: SG1210
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 5 - protein, 771 aa, Artificial sequence
  Synthetic polypeptide
  misc_feature: SG1215
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 6 - protein, 771 aa, Artificial sequence
  Synthetic polypeptide
  misc_feature: SG1216
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 7 - protein, 771 aa, Artificial sequence
  Synthetic polypeptide
  misc_feature: SG1214
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 8 - protein, 771 aa, Artificial sequence
  Synthetic polypeptide
  misc_feature: SG1220
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 9 - protein, 766 aa, Artificial sequence
  Synthetic polypeptide
  misc_feature: SG1210T5 (C-terminal truncation of 5 amino acids)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLG

SEQ ID NO: 10 - protein, 761 aa, Artificial sequence
  Synthetic polypeptide
  misc_feature: SG1210T10 (C-terminal truncation of 10 amino acids)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTK

SEQ ID NO: 11 - protein, 758 aa, Artificial sequence
  Synthetic polypeptide
  misc_feature: SG1210T13 (C-terminal truncation of 13 amino acids)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQ

SEQ ID NO: 12 - protein, 755 aa, Artificial sequence
  Synthetic polypeptide
  misc_feature: SG1210T16 (C-terminal truncation of 16 amino acids)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDL

SEQ ID NO: 13 - protein, 771 aa, Artificial sequence
  Synthetic polypeptide
  misc_feature: SG1217
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 14 - protein, 771 aa, Artificial sequence
  Synthetic polypeptide
  misc_feature: SG1245
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 15 - protein, 771 aa, Artificial sequence
  Synthetic polypeptide
  misc_feature: SG1243
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 16 - protein, 771 aa, Artificial sequence
  Synthetic polypeptide
  misc_feature: SG1229
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 17 - protein, 771 aa, Artificial sequence
  Synthetic polypeptide
  misc_feature: SG1247
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 18 - protein, 771 aa, Artificial sequence
  Synthetic polypeptide
  misc_feature: SG1408
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 19 - protein, 771 aa, Artificial sequence
  Synthetic polypeptide
  misc_feature: SG1441
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 20 - protein, 771 aa, Artificial sequence
  Synthetic polypeptide
  misc_feature: SG1251
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 21 - protein, 771 aa, Artificial sequence
  Synthetic polypeptide
  misc_feature: SG1253
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 22 - protein, 771 aa, Artificial sequence
  Synthetic polypeptide
  misc_feature: SG1257
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEVVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 23 - protein, 771 aa, Artificial sequence
  Synthetic polypeptide
  misc_feature: SG1250
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 24 - protein, 771 aa, Artificial sequence
  Synthetic polypeptide
  misc_feature: SG1227
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 25 - protein, 771 aa, Artificial sequence
  Synthetic polypeptide
  misc_feature: SG1433
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVSKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 26 - protein, 771 aa, Artificial sequence
  Synthetic polypeptide
  misc_feature: SG1429
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVAAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 27 - protein, 771 aa, Artificial sequence
  Synthetic polypeptide
  misc_feature: SG1426
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 28 - protein, 771 aa, Artificial sequence
  Synthetic polypeptide
  misc_feature: SG1420
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 29 - protein, 771 aa, Artificial sequence
  Synthetic polypeptide
  misc_feature: SG1415
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEWKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 30 - protein, 771 aa, Artificial sequence
  Synthetic polypeptide
  misc_feature: SG1418
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 31 - protein, 771 aa, Artificial sequence
  Synthetic polypeptide
  misc_feature: SG1424
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 32 - protein, 771 aa, Artificial sequence
  Synthetic polypeptide
  misc_feature: SG1460
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 33 - protein, 771 aa, Artificial sequence
  Synthetic polypeptide
  misc_feature: SG1459
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEVVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 34 - protein, 771 aa, Artificial sequence
  Synthetic polypeptide
  misc_feature: SG1458
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 35 - protein, 771 aa, Artificial sequence
  Synthetic polypeptide
  misc_feature: SG1462
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 36 - protein, 771 aa, Artificial sequence
  Synthetic polypeptide
  misc_feature: SG1461
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 37 - protein, 771 aa, Artificial sequence
  Synthetic polypeptide
  misc_feature: SG1463
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAINEFDPKKHKYDAEYYIENQVLPAVERILRAFGYRKEDLKYQKTKQVGLGAWLKF

SEQ ID NO: 38 - protein, 771 aa, Artificial sequence
  Synthetic polypeptide
  misc_feature: SG1464
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 39 - protein, 771 aa, Artificial sequence
  Synthetic polypeptide
  misc_feature: SG1457
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKALDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 40 - protein, 771 aa, Artificial sequence
  Synthetic polypeptide
  misc_feature: SG1412
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKMLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 41 - protein, 771 aa, Artificial sequence
  Synthetic polypeptide
  misc_feature: SG1419
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYLDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 42 - protein, 771 aa, Artificial sequence
  Synthetic polypeptide
  misc_feature: SG1235
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 43 - protein, 771 aa, Artificial sequence
  Synthetic polypeptide
  misc_feature: SG1236
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 44 - protein, 771 aa, Artificial sequence
  Synthetic polypeptide
  misc_feature: SG1237
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 45 - protein, 771 aa, Artificial sequence
  Synthetic polypeptide
  misc_feature: SG1266
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 46 - protein, 771 aa, Artificial sequence
  Synthetic polypeptide
  misc_feature: SG1262
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 47 - protein, 771 aa, Artificial sequence
  Synthetic polypeptide
  misc_feature: SG1264
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 48 - protein, 771 aa, Artificial sequence
  Synthetic polypeptide
  misc_feature: SG1442
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 49 - protein, 771 aa, Artificial sequence
  Synthetic polypeptide
  misc_feature: SG1445
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVSKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 50 - protein, 771 aa, Artificial sequence
  Synthetic polypeptide
  misc_feature: SG1452
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 51 - protein, 771 aa, Artificial sequence
  Synthetic polypeptide
  misc_feature: SG1453
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 52 - protein, 771 aa, Artificial sequence
  Synthetic polypeptide
  misc_feature: SG1455
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 53 - protein, 771 aa, Artificial sequence; identical to SEQ ID NO: 39
  Synthetic polypeptide
  misc_feature: SG1457

SEQ ID NO: 54 - protein, 771 aa, Artificial sequence
  Synthetic polypeptide
  misc_feature: SG1465
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 55 - protein, 771 aa, Artificial sequence; identical to SEQ ID NO: 4
  Synthetic polypeptide
  misc_feature: SG1210 (AGI, aka A63)

SEQ ID NO: 56 - protein, 771 aa, Artificial sequence
  Synthetic polypeptide
  misc_feature: A61 (AGV)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 57 - protein, 771 aa, Artificial sequence
  Synthetic polypeptide
  misc_feature: A56 (HGI)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSHGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 58 - protein, 771 aa, Artificial sequence
  Synthetic polypeptide
  misc_feature: A62 (AGL)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGLSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 59 - protein, 771 aa, Artificial sequence
  Synthetic polypeptide
  misc_feature: A65 (AGP)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 60 - protein, 771 aa, Artificial sequence
  Synthetic polypeptide
  misc_feature: A49 (SGI)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 61 - protein, 771 aa, Artificial sequence
  Synthetic polypeptide
  misc_feature: A59 (AGG)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGGSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 62 - protein, 771 aa, Artificial sequence
  Synthetic polypeptide
  misc_feature: A39 (GGI)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSGGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 63 - protein, 771 aa, Artificial sequence
  Synthetic polypeptide
  misc_feature: A46 (YGI)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSYGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 64 - protein, 771 aa, Artificial sequence
  Synthetic polypeptide
  misc_feature: A60 (AGA)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGASIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 65 - protein, 771 aa, Artificial sequence
  Synthetic polypeptide
  misc_feature: A69 (AGS)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGSSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 66 - protein, 771 aa, Artificial sequence
  Synthetic polypeptide
  misc_feature: A70 (AGT)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGTSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 67 - protein, 771 aa, Artificial sequence
  Synthetic polypeptide
  misc_feature: A101 (SGS)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGSSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 68 - protein, 771 aa, Artificial sequence
  Synthetic polypeptide
  misc_feature: A177 (QAI)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSQAISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 69 - protein, 771 aa, Artificial sequence
  Synthetic polypeptide
  misc_feature: A178 (YSC)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSYSCSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 70 - protein, 771 aa, Artificial sequence
  Synthetic polypeptide
  misc_feature: A179 (FSA)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSFSASIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 71 - protein, 771 aa, Artificial sequence
  Synthetic polypeptide
  misc_feature: SG1100
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 72 - protein, 771 aa, Artificial sequence
  Synthetic polypeptide
  misc_feature: SG1105
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 73 - protein, 771 aa, Artificial sequence
  Synthetic polypeptide
  misc_feature: SG1107
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 74 - protein, 771 aa, Artificial sequence
  Synthetic polypeptide
  misc_feature: SG1124
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 75 - protein, 771 aa, Artificial sequence
  Synthetic polypeptide
  misc_feature: SG1130
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAINEFDPKKHKYDAEYYIENQVLPAVERILRAFGYRKEDLKYQKTKQVGLGAWLKF

SEQ ID NO: 76 - protein, 771 aa, Artificial sequence
  Synthetic polypeptide
  misc_feature: SG1132
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 77 - protein, 771 aa, Artificial sequence
  Synthetic polypeptide
  misc_feature: SG1134
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 78 - protein, 771 aa, Artificial sequence
  Synthetic polypeptide
  misc_feature: SG1143
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 79 - protein, 771 aa, Artificial sequence
  Synthetic polypeptide
  misc_feature: SG1145
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 80 - protein, 771 aa, Artificial sequence
  Synthetic polypeptide
  misc_feature: SG1146
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 81 - protein, 771 aa, Artificial sequence
  Synthetic polypeptide
  misc_feature: SG1147
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 82 - protein, 771 aa, Artificial sequence
  Synthetic polypeptide
  misc_feature: SG1154
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 83 - protein, 771 aa, Artificial sequence
  Synthetic polypeptide
  misc_feature: SG1155
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKALDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 84 - protein, 771 aa, Artificial sequence
  Synthetic polypeptide
  misc_feature: SG1156
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 85 - protein, 771 aa, Artificial sequence
  Synthetic polypeptide
  misc_feature: SG1160
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 86 - protein, 771 aa, Artificial sequence
  Synthetic polypeptide
  misc_feature: SG1161
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISARAIAIEEFDPKKHKYDAEYYIENQVLPAVERILRAFGYRKEDLKYQKTKQVGLGAWLKF

SEQ ID NO: 87 - protein, 771 aa, Artificial sequence
  Synthetic polypeptide
  misc_feature: SG1194
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 88 - protein, 771 aa, Artificial sequence
  Synthetic polypeptide
  misc_feature: A2 (AAV, backbone SG1100)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAAVSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 89 - protein, 771 aa, Artificial sequence
  Synthetic polypeptide
  misc_feature: A25 (SAP, backbone SG1100)
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIATLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 90 - protein, 771 aa, Artificial sequence
  Synthetic polypeptide
  misc_feature: SG1494
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 91 - protein, 771 aa, Artificial sequence
  Synthetic polypeptide
  misc_feature: SG1495
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 92 - protein, 771 aa, Artificial sequence
  Synthetic polypeptide
  misc_feature: SG1496
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 93 - protein, 771 aa, Artificial sequence
  Synthetic polypeptide
  misc_feature: SG1497
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 94 - protein, 771 aa, Artificial sequence
  Synthetic polypeptide
  misc_feature: SG1498
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIEAQVLPAVERILRAFGYRKEDLKYQKTKQVGLGAWLKF

SEQ ID NO: 95 - protein, 771 aa, Artificial sequence
  Synthetic polypeptide
  misc_feature: SG1499
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 96 - protein, 771 aa, Artificial sequence
  Synthetic polypeptide
  misc_feature: SG1600
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 97 - protein, 771 aa, Artificial sequence
  Synthetic polypeptide
  misc_feature: SG1601
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 98 - protein, 771 aa, Artificial sequence
  Synthetic polypeptide
  misc_feature: SG1602
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 99 - protein, 771 aa, Artificial sequence
  Synthetic polypeptide
  misc_feature: SG1603
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 100 - protein, 771 aa, Artificial sequence
  Synthetic polypeptide
  misc_feature: SG1604
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 101 - protein, 771 aa, Artificial sequence
  Synthetic polypeptide
  misc_feature: SG1605
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 102 - protein, 771 aa, Artificial sequence
  Synthetic polypeptide
  misc_feature: SG1606
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 103 - protein, 771 aa, Artificial sequence
  Synthetic polypeptide
  misc_feature: SG1607
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 104 - protein, 771 aa, Artificial sequence
  Synthetic polypeptide
  misc_feature: SG1608
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 105 - protein, 771 aa, Artificial sequence
  Synthetic polypeptide
  misc_feature: SG1609
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 106 - protein, 771 aa, Artificial sequence
  Synthetic polypeptide
  misc_feature: SG1610
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 107 - protein, 771 aa, Artificial sequence
  Synthetic polypeptide
  misc_feature: SG1611
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 108 - protein, 771 aa, Artificial sequence
  Synthetic polypeptide
  misc_feature: SG1612
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 109 - protein, 771 aa, Artificial sequence
  Synthetic polypeptide
  misc_feature: SG1613
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIEAQVLPAVERILRAFGYRKEDLKYQKTKQVGLGAWLKF

SEQ ID NO: 110 - protein, 771 aa, Artificial sequence
  Synthetic polypeptide
  misc_feature: SG1614
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 111 - protein, 771 aa, Artificial sequence
  Synthetic polypeptide
  misc_feature: SG1615
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 112 - protein, 771 aa, Artificial sequence
  Synthetic polypeptide
  misc_feature: SG1616
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 113 - protein, 771 aa, Artificial sequence
  Synthetic polypeptide
  misc_feature: SG1617
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 114 - protein, 771 aa, Artificial sequence
  Synthetic polypeptide
  misc_feature: SG1618
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 115 - protein, 771 aa, Artificial sequence
  Synthetic polypeptide
  misc_feature: SG1619
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISERAIAIEEFDPKKHKYDAEYYIENQVLPAVERILRAFGYRKEDLKYQKTKQVGLGAWLKF

SEQ ID NO: 116 - protein, 771 aa, Artificial sequence
  Synthetic polypeptide
  misc_feature: SG1620
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIAEFDPKKHKYDAEYYIENQVLPAVERILRAFGYRKEDLKYQKTKQVGLGAWLKF

SEQ ID NO: 117 - protein, 771 aa, Artificial sequence
  Synthetic polypeptide
  misc_feature: SG1621
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISEAAIAIEEFDPKKHKYDAEYYIENQVLPAVERILRAFGYRKEDLKYQKTKQVGLGAWLKF

SEQ ID NO: 118 - protein, 771 aa, Artificial sequence
  Synthetic polypeptide
  misc_feature: SG1622
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 119 - protein, 771 aa, Artificial sequence
  Synthetic polypeptide
  misc_feature: SG1623
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 120 - protein, 771 aa, Artificial sequence
  Synthetic polypeptide
  misc_feature: SG1624
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 121 - protein, 771 aa, Artificial sequence
  Synthetic polypeptide
  misc_feature: SG1625
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 122 - protein, 771 aa, Artificial sequence
  Synthetic polypeptide
  misc_feature: SG1626
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 123 - protein, 771 aa, Artificial sequence
  Synthetic polypeptide
  misc_feature: SG1627
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 124 - protein, 771 aa, Artificial sequence
  Synthetic polypeptide
  misc_feature: SG1628
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 125 - protein, 771 aa, Artificial sequence
  Synthetic polypeptide
  misc_feature: SG1629
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 126 - protein, 771 aa, Artificial sequence
  Synthetic polypeptide
  misc_feature: SG1630
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIEAQVLPAVERILRAFGYRKEDLKYQKTKQVGLGAWLKF

SEQ ID NO: 127 - protein, 771 aa, Artificial sequence
  Synthetic polypeptide
  misc_feature: SG1631
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 128 - protein, 771 aa, Artificial sequence
  Synthetic polypeptide
  misc_feature: SG1632
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 129 - protein, 771 aa, Artificial sequence
  Synthetic polypeptide
  misc_feature: SG1633
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 130 - protein, 771 aa, Artificial sequence
  Synthetic polypeptide
  misc_feature: SG1634
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 131 - protein, 771 aa, Artificial sequence
  Synthetic polypeptide
  misc_feature: SG1635
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 132 - protein, 771 aa, Artificial sequence
  Synthetic polypeptide
  misc_feature: SG1636
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 133 - protein, 771 aa, Artificial sequence
  Synthetic polypeptide
  misc_feature: SG1637
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 134 - protein, 771 aa, Artificial sequence
  Synthetic polypeptide
  misc_feature: SG1638
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 135 - protein, 771 aa, Artificial sequence
  Synthetic polypeptide
  misc_feature: SG1639
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 136 - protein, 771 aa, Artificial sequence
  Synthetic polypeptide
  misc_feature: SG1640
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 137 - protein, 771 aa, Artificial sequence
  Synthetic polypeptide
  misc_feature: SG1641
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 138 - protein, 771 aa, Artificial sequence
  Synthetic polypeptide
  misc_feature: SG1642
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 139 - protein, 771 aa, Artificial sequence
  Synthetic polypeptide
  misc_feature: SG1643
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 140 - protein, 771 aa, Artificial sequence
  Synthetic polypeptide
  misc_feature: SG1644
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 141 - protein, 771 aa, Artificial sequence
  Synthetic polypeptide
  misc_feature: SG1645
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIEAQVLPAVERILRAFGYRKEDLKYQKTKQVGLGAWLKF

SEQ ID NO: 142 - protein, 771 aa, Artificial sequence
  Synthetic polypeptide
  misc_feature: SG1646
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 143 - protein, 771 aa, Artificial sequence
  Synthetic polypeptide
  misc_feature: SG1647
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 144 - protein, 771 aa, Artificial sequence
  Synthetic polypeptide
  misc_feature: SG1648
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 145 - protein, 771 aa, Artificial sequence
  Synthetic polypeptide
  misc_feature: SG1649
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 146 - protein, 771 aa, Artificial sequence
  Synthetic polypeptide
  misc_feature: SG1650
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 147 - protein, 771 aa, Artificial sequence
  Synthetic polypeptide
  misc_feature: SG1651
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISERAIAIEEFDPKKHKYDAEYYIENQVLPAVERILRAFGYRKEDLKYQKTKQVGLGAWLKF

SEQ ID NO: 148 - protein, 771 aa, Artificial sequence
  Synthetic polypeptide
  misc_feature: SG1652
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIAEFDPKKHKYDAEYYIENQVLPAVERILRAFGYRKEDLKYQKTKQVGLGAWLKF

SEQ ID NO: 149 - protein, 771 aa, Artificial sequence
  Synthetic polypeptide
  misc_feature: SG1653
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISEAAIAIEEFDPKKHKYDAEYYIENQVLPAVERILRAFGYRKEDLKYQKTKQVGLGAWLKF

SEQ ID NO: 150 - protein, 771 aa, Artificial sequence
  Synthetic polypeptide
  misc_feature: SG1654
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 151 - protein, 771 aa, Artificial sequence
  Synthetic polypeptide
  misc_feature: SG1655
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 152 - protein, 771 aa, Artificial sequence
  Synthetic polypeptide
  misc_feature: SG1656
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSAGPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 153 - protein, 771 aa, Artificial sequence
  Synthetic polypeptide
  misc_feature: SG1657
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 154 - protein, 771 aa, Artificial sequence
  Synthetic polypeptide
  misc_feature: SG1658
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 155 - protein, 771 aa, Artificial sequence
  Synthetic polypeptide
  misc_feature: SG1659
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 156 - protein, 771 aa, Artificial sequence
  Synthetic polypeptide
  misc_feature: SG1660
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 157 - protein, 771 aa, Artificial sequence
  Synthetic polypeptide
  misc_feature: SG1661
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 158 - protein, 771 aa, Artificial sequence
  Synthetic polypeptide
  misc_feature: SG1662
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIEAQVLPAVERILRAFGYRKEDLKYQKTKQVGLGAWLKF

SEQ ID NO: 159 - protein, 771 aa, Artificial sequence
  Synthetic polypeptide
  misc_feature: SG1663
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 160 - protein, 771 aa, Artificial sequence
  Synthetic polypeptide
  misc_feature: SG1664
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 161 - protein, 771 aa, Artificial sequence
  Synthetic polypeptide
  misc_feature: SG1665
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 162 - protein, 771 aa, Artificial sequence
  Synthetic polypeptide
  misc_feature: SG1666
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 163 - protein, 771 aa, Artificial sequence
  Synthetic polypeptide
  misc_feature: SG1667
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 164 - protein, 771 aa, Artificial sequence
  Synthetic polypeptide
  misc_feature: SG1668
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 165 - protein, 771 aa, Artificial sequence
  Synthetic polypeptide
  misc_feature: SG1669
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 166 - protein, 771 aa, Artificial sequence
  Synthetic polypeptide
  misc_feature: SG1670
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 167 - protein, 771 aa, Artificial sequence
  Synthetic polypeptide
  misc_feature: SG1671
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 168 - protein, 770 aa, Artificial sequence
  Synthetic polypeptide
  misc_feature: SG1672
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSGIIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 169 - protein, 771 aa, Artificial sequence
  Synthetic polypeptide
  misc_feature: SG1673
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPAEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSGISIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 170 - protein, 771 aa, Artificial sequence
  Synthetic polypeptide
  misc_feature: SG1326
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 171 - protein, 771 aa, Artificial sequence
  Synthetic polypeptide
  misc_feature: SG1327
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 172 - protein, 771 aa, Artificial sequence
  Synthetic polypeptide
  misc_feature: SG1328
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 173 - protein, 771 aa, Artificial sequence
  Synthetic polypeptide
  misc_feature: SG1329
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 174 - protein, 771 aa, Artificial sequence
  Synthetic polypeptide
  misc_feature: SG1330
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 175 - protein, 771 aa, Artificial sequence
  Synthetic polypeptide
  misc_feature: SG1331
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIEAQVLPAVERILRAFGYRKEDLKYQKTKQVGLGAWLKF

SEQ ID NO: 176 - protein, 771 aa, Artificial sequence
  Synthetic polypeptide
  misc_feature: SG1332
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 177 - protein, 771 aa, Artificial sequence
  Synthetic polypeptide
  misc_feature: SG1333
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 178 - protein, 771 aa, Artificial sequence
  Synthetic polypeptide
  misc_feature: SG1334
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 179 - protein, 771 aa, Artificial sequence
  Synthetic polypeptide
  misc_feature: SG1335
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 180 - protein, 771 aa, Artificial sequence
  Synthetic polypeptide
  misc_feature: SG1336
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 181 - protein, 771 aa, Artificial sequence
  Synthetic polypeptide
  misc_feature: SG1337
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 182 - protein, 771 aa, Artificial sequence
  Synthetic polypeptide
  misc_feature: SG1338
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 183 - protein, 771 aa, Artificial sequence
  Synthetic polypeptide
  misc_feature: SG1339
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 184 - protein, 771 aa, Artificial sequence
  Synthetic polypeptide
  misc_feature: SG1340
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 185 - protein, 771 aa, Artificial sequence
  Synthetic polypeptide
  misc_feature: SG1341
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 186 - protein, 771 aa, Artificial sequence
  Synthetic polypeptide
  misc_feature: SG1342
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSAVSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 187 - protein, 771 aa, Artificial sequence
  Synthetic polypeptide
  misc_feature: SG1343
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 188 - protein, 771 aa, Artificial sequence
  Synthetic polypeptide
  misc_feature: SG1344
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISERAIAIEEFDPKKHKYDAEYYIENQVLPAVERILRAFGYRKEDLKYQKTKQVGLGAWLKF

SEQ ID NO: 189 - protein, 771 aa, Artificial sequence
  Synthetic polypeptide
  misc_feature: SG1345
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYLDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 190 - protein, 771 aa, Artificial sequence
  Synthetic polypeptide
  misc_feature: SG1346
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRLIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 191 - protein, 771 aa, Artificial sequence
  Synthetic polypeptide
  misc_feature: SG1347
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGAIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 192 - protein, 771 aa, Artificial sequence
  Synthetic polypeptide
  misc_feature: SG1348
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIEAQVLPAVERILRAFGYRKEDLKYQKTKQVGLGAWLKF

SEQ ID NO: 193 - protein, 771 aa, Artificial sequence
  Synthetic polypeptide
  misc_feature: SG1349
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEAKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 194 - protein, 771 aa, Artificial sequence
  Synthetic polypeptide
  misc_feature: SG1350
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKALLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 195 - protein, 771 aa, Artificial sequence
  Synthetic polypeptide
  misc_feature: SG1351
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKSLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 196 - protein, 771 aa, Artificial sequence
  Synthetic polypeptide
  misc_feature: SG1352
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEAASLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 197 - protein, 771 aa, Artificial sequence
  Synthetic polypeptide
  misc_feature: SG1353
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDELVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 198 - protein, 771 aa, Artificial sequence
  Synthetic polypeptide
  misc_feature: SG1354
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLAGDGPISKRAIAIEEFDPKKHKYDAEYYIENQVLPAVERILRAFGYRKEDLKYQKTKQVGLGAWLKF

SEQ ID NO: 199 - protein, 771 aa, Artificial sequence
  Synthetic polypeptide
  misc_feature: SG1355
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIAEFDPKKHKYDAEYYIENQVLPAVERILRAFGYRKEDLKYQKTKQVGLGAWLKF

SEQ ID NO: 200 - protein, 771 aa, Artificial sequence
  Synthetic polypeptide
  misc_feature: SG1356
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKAAIAIEEFDPKKHKYDAEYYIENQVLPAVERILRAFGYRKEDLKYQKTKQVGLGAWLKF

SEQ ID NO: 201 - protein, 771 aa, Artificial sequence
  Synthetic polypeptide
  misc_feature: SG1357
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 202 - protein, 771 aa, Artificial sequence
  Synthetic polypeptide
  misc_feature: SG1358
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 203 - protein, 771 aa, Artificial sequence
  Synthetic polypeptide
  misc_feature: SG1359
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVAIAALYHEGEEFEKGPIIMISYADEEGAKVITWKSIDLPYVEVVSSEREMIKRLVKVIREKDPDVIITYNGDNFAFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEAAKVTFELGKEFFPMEAQLARLVGQPVWDVSRSSTGNLVEWFLLRKAYERNELAPNKPDEREYERRLRESYEGGYVKEPEKGLWEGIVSLDFRSSAPSIIITHNVSPDTLNRENCKEYDVAPQVGHRFCKDFPGFIPSLLGNLLEERQKIKKRMKESKDPVEKKLLDYRQRVIKILANSYYGYYGYAKARWYCKECAESVSAWGRQYIDLVRRELESRGFKVLYIDTDGLYATIPGAKHEEIKEKALKFVEYINSKLPGLLELEYEGFYARGFFVIKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 204 - DNA, 59 bp, Artificial sequence
  Synthetic polynucleotide
  misc_feature: 160-1
gactcacatgaatcagtgcagcatcagatgtatgaccgaagcggacgaaggtgcgtgga

SEQ ID NO: 205 - DNA, 59 bp, Artificial sequence
  Synthetic polynucleotide
  misc_feature: 160-2
gtggttcatcgcgtccgatatcaaacttcgtcaagtcgaagcggacgaaggtgcgtgga

SEQ ID NO: 206 - DNA, 59 bp, Artificial sequence
  Synthetic polynucleotide
  misc_feature: 160-3
tactaggttgtacgatccctgcacttcagctaagcacgaagcggacgaaggtgcgtgga

SEQ ID NO: 207 - DNA, 59 bp, Artificial sequence
  Synthetic polynucleotide
  misc_feature: 160-4
agctaccaatatttagtttccgagtctcagctcatgcgaagcggacgaaggtgcgtgga

SEQ ID NO: 208 - DNA, 36 bp, Artificial sequence
  Synthetic polynucleotide
  misc_feature: 160 primer
  misc_feature (1)..(1): 5'-Biotin
aaaaaaaaaaaagtccacgcaccttcgtccgcttcg

SEQ ID NO: 209 - protein, 775 aa, Artificial sequence
  Synthetic polypeptide
  misc_feature: 9oN-7 Wild Type SG90
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 210 - protein, 783 aa, Artificial sequence
  Synthetic polypeptide
  misc_feature: SG3000 (Pyrobaculum calidifontis)
MRFWPLDATYSVVGGVPEVRVFGVDGEGRRVVLVDRRFRPYFYAKCDKCDASLAKSYLSRVAPVEAVEVVERRFFGRPTIFLKVVAKVPEDVRKLREAALGAPGVVDVYEADIRYYMRYMIDKGVVPCAWNVVEAREAGKLGPLPLYEVVEWAGVEEGFPPPLRVLAFDIEVYNERGSPDPLRDPVVMLAVKTSDGREEVFEAEGRDDRRVIRGFVDFVKEFDPDVIVGYNSNGFDWPYLSERAKALGVPLRVDRLGGVPQQSVYGHWSVVGRANVDLYNIVDEFPEIKVKTLDRVAEYFGVMKRSERVLIPGHKVYEYWNDPAKRPTLMRYVLDDVRSTLGLAEKLLPFLIQLSSVSGLPLDQVAAASVGNRVEWMLLRYAYRMGEVAPNREEREYEPYKGAIVLEPKPGLYSDVLVLDFSSMYPNIMMKYNLSPDTYLEPHEPDPPEGVVVAPEVGHRFRKAPTGFIPAVLKHLVELRRAVREEAKKYPPDSPEYRLLDERQRALKVMANAMYGYLGWVGARWYKKEVAESVTAFARAILLDVVEYAKRLGIEVIYGDTDSLFVKKSGAVDRLVKYVEERHGIEIKVDKDYERVLFTEAKKRYAGLLRDGRIDIVGFEVVRGDWCELAKEVQLNVVELILKSKSVGEARERVVKYVREVVERLKAYKFDLDDLIIWKTLDKELDEYKAYGPHVHAALELKRRGYKVGKGTTVGYVIVRGPGKVSERAMPYIFVDDASKVDVDYYIEKQVIPAALRIAEVLGVKESDLKTGRVEKSLLDFLG

SEQ ID NO: 211 - protein, 775 aa, Artificial sequence
  Synthetic polypeptide
  misc_feature: 9oN-7 exo- Therminator (D141A, E143A, A485L)
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRLIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 212 - protein, 775 aa, Artificial sequence
  Synthetic polypeptide
  misc_feature: SG92 Therminator II NEB
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLVPSIIITHNVSPDTLNREGCKEYDVAPEVGHKFCKDFPGFIPSLLGDLLEERQKIKRKMKATVDPLEKKLLDYRQRLIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 213 - protein, 775 aa, Artificial sequence
  Synthetic polypeptide
  misc_feature: SG100 Therminator III NEB
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSSAVSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 214 - protein, 775 aa, Artificial sequence
  Synthetic polypeptide
  misc_feature: SG200 sequence Pol812
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPAEGDEELTMLAFAIATLYHEGEEFGTGPILMISYADGSEARVITWKKIDLPYVDVVSTEKEMIKRFLRVVREKDPDVLITYNGDNFDFAYLKKRSEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSAAISIIITHNVSPDTLNREGCKEYDVAPEVGHKFCKDFPGFIPSLLGDLLEERQKIKRKMKATVDPLEKKLLDYRQRVIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 215 - DNA, 6276 bp, Artificial sequence
  Synthetic polynucleotide
  misc_feature: full plasmid sequence to generate P. abyssi protein SG1200
cccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaggcgagagtagggaactgccaggcatcaaactaagcagaaggcccctgacggatggcctttttgcgtttctacaaactctttctgtgttgtaaaacgacggccagtcttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatatcaaaattatacatgtcaacgataatacaaaatataatacaaactataagatgttatcagtatttattatgcatttagaataaattttgtgtcgcccttccgcgaaattaatacgactcactataggggaattgtgagcggataacaattcccctctagaaataattttgtttaactttttgagaccttaaggaggtaaaaaatgattattgacgcagactacatcaccgaagatggcaaaccgattatccgcattttcaaaaaagaaaagggtgagtttaaagttgagtatgatcgtaccttccgtccgtacatttacgctttgctgaaagacgatagcgcgattgacgaagtcaagaaaatcacggccgagcgtcacggtaagattgtccgtatcaccgaagttgaaaaggttcagaaaaagtttctgggtcgtccgattgaggtctggaaactgtatctggagcacccacaagatgtgccggcgatccgcgagaaaattcgtgaacatccggcagttgttgatatcttcgagtacgatatcccgttcgcaaagcgttatctgatcgataagggtctgaccccggcagagggtaacgaagaactgacgtttctggcagtggcaattgcgaccctgtatcacgagggtgaagaatttggcaagggtccgattatcatgatcagctatgcggacgaagagggcgcaaaggttatcacgtggaaaagcattgatctgccgtacgtcgaagttgtgtcgagcgagcgtgagatgattaagcgtctggttaaggttatccgtgagaaagacccggacgtgattatcacctacaatggtgacaactttgatttcccgtatctgctgaagcgcgcagagaaactgggcatcaagctgccgttgggtcgtgacaactccgagccgaagatgcagcgcatgggtgatagccttgcggttgagattaagggtcgtattcatttcgacctctttccggttatccgtcgcaccattaatctgccaacgtacaccctggaagctgtgtacgaagcgatctttggtaagagcaaagaaaaagtgtacgctcacgagatcgcagaggcatgggagactggtaagggcttggaacgcgtcgccaagtatagcatggaagatgcgaaagtgacctttgaattgggtaaagaattttttccaatggaagcgcaactggcgcgtttggtcggtcagcctgtgtgggacgttagccgtagctctacgggtaacctggtagaatggttcctgctgcgtaaggcctacgagcgcaacgaactggccccaaacaaaccggatgaacgcgagtatgagcgccgtctgcgcgagtcgtacgagggcggttatgtgaaagaaccggagaaaggcctgtgggagggtattgtcagcctggactttcgctccgcagctatcagcatcatcattactcacaacgtgagcccggacacgctgaaccgtgagaattgtaaagaatatgacgtggcgcctcaggttggtcatcgtttttgcaaagactttccgggtttcatcccgagcttgctgggtaacttgctggaggaacgccaaaaaatcaaaaagcgcatgaaagagagcaaagacccggttgagaaaaagctgctggattaccgccaacgcgttattaaaatcctggcgaatagctattacggctattatggttacgcaaaggctcgttggtactgtaaagagtgcgcggagagcgtgacggcatggggccgtcaatacattgacctggtccgtcgtgaactggaatcccgcggtttcaaagtgctgtacattgataccgacggtctgtatgcgaccatcccaggcgcgaaacatgaagaaatcaaagaaaaagcgctgaaattcgttgaatatattaatagcaaactgccgggtctgctggaactggagtacgagggcttttatgcccgtggcttcttcgtgacgaagaaaaaatatgcgttaatcgatgaagagggcaagattgtcacgcgtggtctggagatcgtgcgtcgtgattggtctgagatcgcgaaagaaacccaggcgaaagtcctggaagctatcctgaaacacggtaatgtcgatgaagctgtgaagattgttaaggaagttaccgagaaattgagcaaatatgaaattccgccggagaaactggttatctacgaacagatcacccgtccgctctccgagtacaaagcgattggcccacacgtcgcggtcgccaagcgtctggccgcaaagggtgtcaaagtgaagcctggtatggtcattggttacatcgtgttacgtggcgatggcccgattagcaagagagctattgccatcgaagaattcgacccgaaaaagcacaaatacgatgcggagtactatattgaaaatcaagttctgccggcagtcgagcgtattctgcgtgcgttcggctaccgcaaagaggacctgaagtaccagaaaaccaaacaagttggcttgggcgcctggctgaaattctaatgaggttgaggtctcaccccctagcataaccccttggggcctctaaacgggtcttgaggggttttttgcccctgagacgcgtcaatcgagttcgtacctaagggcgacaccccctaattagcccgggcgaaaggcccagtctttcgactgagcctttcgttttatttgatgcctggcagttccctactctcgcatggggagtccccacactaccatcggcgctacggcgtttcacttctgagttcggcatggggtcaggtgggaccaccgcgctactgccgccaggcaaacaaggggtgttatgagccatattcaggtataaatgggctcgcgataatgttcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagcggcgcgccatcgaatggcgcaaaacctttcgcggtatggcatgatagcgcccggaagagagtcaattcagggtggtgaatatgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaggacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagatagctcatgttatatcccgccgttaaccaccatcaaacaggattttcgcctgctggggcaaaccagcgtggaccgcttgctgcaactctctcagggccaggcggtgaagggcaatcagctgttgccagtctcactggtgaaaagaaaaaccaccctggcgcccaatacgcaaaccgcctctccccgcgcgttggccgattcattaatgcagctggcacgacaggtttcccgactggaaagcgggcagtgactcatgaccaaaatcccttaacgtgagttacgcgcgcgtcgttccactgagcgtcagac

What is claimed:

1. A polymerase comprising an amino acid sequence that is at least 85% identical to a continuous 500 amino acid sequence within SEQ ID NO: 1; comprising the following amino acids:
    an alanine at amino acid position 409 or at a position corresponding to amino acid position 409;
    a glycine at amino acid position 410 or at a position corresponding to amino acid position 410; and
    a proline at amino acid position 411 or at a position corresponding to amino acid position 411.

2. The polymerase of claim 1, wherein the polymerase comprises an amino acid sequence that is at least 95% identical to a continuous 500 amino acid sequence within SEQ ID NO: 1.

3. The polymerase of claim 1, wherein the polymerase further comprises an amino acid substitution mutation between position 129 and 316 of SEQ ID NO: 1, inclusive of positions 129 and 316.

4. The polymerase of claim 1, wherein the polymerase further comprises an amino acid substitution mutation at positions 129, 141, and 143.

5. The polymerase of claim 1, wherein the polymerase further comprises an alanine substitution, a glycine substitution, a valine substitution, a leucine substitution, or an isoleucine substitution mutation at position 129.

6. The polymerase of claim 1, wherein the polymerase further comprises an alanine substitution mutation at position 143.

7. The polymerase of claim 1, wherein the polymerase further comprises an alanine substitution mutation at position 144.

8. The polymerase of claim 1, wherein the polymerase further comprises a leucine or valine substitution mutation at position 486.

9. The polymerase of claim 1, wherein the polymerase further comprises serine at position 515.

10. The polymerase of claim 1, wherein the polymerase further comprises isoleucine at position 590.

11. The polymerase of claim 1, comprising the following mutations:
    M129A, D141A, T144A, E143A, L409A, Y410G, A486V, T515S, and T590I;
    M129A, D141A, E143A, L409A, Y410G, and A486V;
    M129A; D141A; T144A; E143A; L409A; Y410G; A486V; T515S; T590I; and G153E;
    M129A; D141A; T144A; E143A; L409A; Y410G; A486V; T515S; T590I; G153E; and K712E;
    M129A; D141A; E143A; T144A; L409A; Y410G; A486V; T515S; T590I; G153E; and I522L;
    M129A; D141A; E143A; T144A; L409A; Y410G; A486L; T515S; T590I; and G153E;
    M129A; D141A; E143A; T144A; L409A; Y410G; A486V; T515S; T590I; G153E; K602A;
    M129A; D141A; E143A; T144A; L409A; Y410G; A486V; T515S; T590I; G153E; and N735A;
    M129A; D141A; E143A; T144A; L409A; Y410G; A486V; T515S; T590I; G153E; and K477A;
    M129A; D141A; E143A; T144A; L409A; Y410G; A486V; T515S; T590I; G153E; and K478A;
    M129A; D141A; E143A; T144A; L409A; Y410G; A486V; T515S; T590I; G153E; and L479S;
    M129A; D141A; E143A; T144A; L409A; Y410G; A486V; T515S; T590I; G153E; K477A; K478A; and L479S;
    M129A; D141A; E143A; T144A; L409A; Y410G; A486V; T515S; T590I; G153E; and A639L;
    M129A; D141A; E143A; T144A; L409A; Y410G; A486V; T515S; T590I; G153E; and R705A;
    M129A; D141A; E143A; T144A; L409A; Y410G; A486V; T515S; T590I; G153E; and E718A;

M129A; D141A; E143A; T144A; L409A; Y410G; A486V; T515S; T590I; G153E; and R713A;
M129A; D141A; E143A; T144A; L409A; Y410G; A486V; T515S; T590I; G153E; and D215A;
M129A; D141A; E143A; T144A; L409A; Y410G; A486V; T515S; T590I; G153E; and D315A;
M129A; D141A; E143A; T144A; L409A; Y410G; A486V; T515S; T590I; G153E; D215A; and D315A;
M129A; D141A; E143A; T144A; L409A; Y410G; A486V; T515S; T590I; G153E; K712E; and I522L;
M129A; D141A; E143A; T144A; L409A; Y410G; A486L; T515S; T590I; G153E; and K712E;
M129A; D141A; E143A; T144A; L409A; Y410G; A486V; T515S; T590I; G153E; K712E; and K602A;
M129A; D141A; E143A; T144A; L409A; Y410G; A486V; T515S; T590I; G153E; K712E; and N735A;
M129A; D141A; E143A; T144A; L409A; Y410G; A486V; T515S; T590I; G153E; K712E; and K477A;
M129A; D141A; E143A; T144A; L409A; Y410G; A486V; T515S; T590I; G153E; K712E; and K478A;
M129A; D141A; E143A; T144A; L409A; Y410G; A486V; T515S; T590I; G153E; K712E; and L479S;
M129A; D141A; E143A; T144A; L409A; Y410G; A486V; T515S; T590I; G153E; K712E; K477A; K478A; and L479S;
M129A; D141A; E143A; T144A; L409A; Y410G; A486V; T515S; T590I; G153E; K712E; and A639L;
M129A; D141A; E143A; T144A; L409A; Y410G; A486V; T515S; T590I; G153E; K712E; and R705A;
M129A; D141A; E143A; T144A; L409A; Y410G; A486V; T515S; T590I; G153E; K712E; and E718A;
M129A; D141A; E143A; T144A; L409A; Y410G; A486V; T515S; T590I; G153E; K712E; and R713A;
M129A; D141A; E143A; T144A; L409A; Y410G; A486V; T515S; T590I; G153E; K712E; and D215A;
M129A; D141A; E143A; T144A; L409A; Y410G; A486V; T515S; T590I; G153E; K712E; and D315A; or
M129A; D141A; E143A; T144A; L409A; Y410G; A486V; T515S; T590I; G153E; K712E; D215A; and D315A.

12. A polymerase comprising an amino acid sequence comprising SEQ ID NO: 1; further comprising the following mutations:
M129A, D141A, E143A, L409A, Y410G, P411L, and A486V;
M129A, D141A, E143A, L409A, Y410G, P411G, and A486V;
M129A, D141A, E143A, L409A, Y410G, P411S, and A486V;
M129A, D141A, E143A, L409A, Y410G, P411T, and A486V;
M129A, D141A, E143A, L409A, Y410G, P411A, and A486V;
M129A, D141A, E143A, L409Q, Y410A, P411I, and A486V; or
M129A, D141A, E143A, L409G, Y410G, P411I, and A486V.

13. The polymerase of claim 1, which exhibits an increased rate of incorporation of modified nucleotides, relative to a wild-type P. abyssi DNA polymerase.

14. The polymerase of claim 1, wherein the amino acid sequence is at least 99% identical to SEQ ID NO: 1.

15. The polymerase of claim 11, wherein the amino acid sequence is at least 99% identical to SEQ ID NO: 1.

16. The polymerase of claim 12, wherein the amino acid sequence is at least 99% identical to SEQ ID NO: 1.

17. The polymerase of claim 1, wherein the polymerase is truncated at the C-terminus.

18. A polymerase comprising an amino acid sequence that is at least 85% identical to a continuous 500 amino acid sequence within SEQ ID NO: 1, comprising an alanine at amino acid position 409 or at a position corresponding to amino acid position 409; and a glycine at amino acid position 410 or at a position corresponding to amino acid position 410.

19. The polymerase of claim 1, wherein the polymerase is capable of incorporating a reversible terminator moiety.

20. The polymerase of claim 18, wherein the polymerase is capable of incorporating a reversible terminator moiety.

21. The polymerase of claim 19, wherein the reversible terminator moiety has the formula:

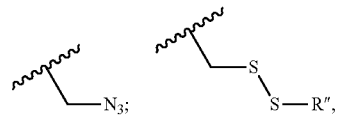

wherein R" is unsubstituted $C_1$-$C_4$ alkyl; or

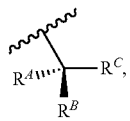

wherein $R^A$ and $R^B$ are hydrogen or alkyl, wherein at least one of $R^A$ or $R^B$ are hydrogen to yield a steroisomeric probe, and $R^C$ is the remainder of the reversible terminator moiety.

22. The polymerase of claim 19, wherein the reversible terminator moiety has the formula

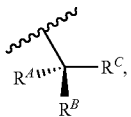

wherein $R^A$ and $R^B$ are hydrogen or alkyl, wherein at least one of $R^A$ or $R^B$ are hydrogen to yield a steroisomeric probe, and $R^C$ is the remainder of the reversible terminator moiety.

23. The polymerase of claim 1, wherein the polymerase further comprises one or more amino acid substitution mutations at position 129, 141, 142, 143, 144, 209, 210, 213, 214, 215, 274, 275, 311, or 315.

24. The polymerase of claim 1, wherein the amino acid sequence is at least 90% identical to SEQ ID NO: 1.

25. The polymerase of claim 1, wherein the polymerase further comprises an amino acid substitution mutation at position 515.

26. The polymerase of claim 1, wherein the polymerase further comprises a valine substitution mutation at position 486.

27. The polymerase of claim 17, wherein the polymerase is truncated to remove at least 20 amino acids from the C-terminus.

28. The polymerase of claim 17, wherein the polymerase is truncated to remove 5 to 16 amino acids from the C-terminus.

* * * * *